US011447531B2

(12) United States Patent
Carlson et al.

(10) Patent No.: US 11,447,531 B2
(45) **Date of Patent: *Sep. 20, 2022**

(54) CLEAVABLE PEPTIDES AND INSECTICIDAL AND NEMATICIDAL PROTEINS COMPRISING SAME

(71) Applicant: Vestaron Corporation, Kalamzoo, MI (US)

(72) Inventors: Alvar R. Carlson, Kalamazoo, MI (US); Alexandra M. Haase, Martin, MI (US); Robert M. Kennedy, Dexter, MI (US)

(73) Assignee: Vestaron Corporation, Kalamazoo, MI (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/343,715

(22) PCT Filed: Oct. 6, 2017

(86) PCT No.: PCT/US2017/055596

§ 371 (c)(1),
(2) Date: Apr. 19, 2019

(87) PCT Pub. No.: WO2018/075269

PCT Pub. Date: Apr. 26, 2018

(65) Prior Publication Data

US 2019/0261634 A1 Aug. 29, 2019

Related U.S. Application Data

(60) Provisional application No. 62/411,117, filed on Oct. 21, 2016.

(51) Int. Cl.

| | |
|---|---|
| ***C07K 7/06*** | (2006.01) |
| ***C07K 14/415*** | (2006.01) |
| ***C12N 15/82*** | (2006.01) |
| ***C07K 14/435*** | (2006.01) |
| ***C12N 15/74*** | (2006.01) |
| ***C12N 15/80*** | (2006.01) |
| ***A61K 35/742*** | (2015.01) |
| ***A01N 37/46*** | (2006.01) |
| ***C07K 14/325*** | (2006.01) |
| *A61K 38/00* | (2006.01) |

(52) U.S. Cl.

CPC ............ *C07K 14/415* (2013.01); *A01N 37/46* (2013.01); *A61K 35/742* (2013.01); *C07K 7/06* (2013.01); *C07K 14/325* (2013.01); *C07K 14/43518* (2013.01); *C07K 14/43531* (2013.01); *C07K 14/43563* (2013.01); *C12N 15/743* (2013.01); *C12N 15/80* (2013.01); *C12N 15/8282* (2013.01); *C12N 15/8285* (2013.01); *C12N 15/8286* (2013.01); *A61K 38/00* (2013.01); *C07K 2319/00* (2013.01); *C07K 2319/04* (2013.01); *C07K 2319/50* (2013.01); *C07K 2319/55* (2013.01); *Y02A 40/146* (2018.01)

(58) Field of Classification Search

CPC ............ C07K 7/06; C07K 7/08; A61K 38/10

See application file for complete search history.

(56) References Cited

U.S. PATENT DOCUMENTS

| | | | |
|---|---|---|---|
| 4,945,050 | A | 7/1990 | Sanford et al. |
| 4,996,155 | A | 2/1991 | Sick et al. |
| 5,045,469 | A | 9/1991 | Payne et al. |
| 5,055,294 | A | 10/1991 | Gilroy |
| 5,073,632 | A | 12/1991 | Donovan |
| 5,104,974 | A | 4/1992 | Sick et al. |
| 5,135,867 | A | 8/1992 | Payne et al. |
| 5,187,091 | A | 2/1993 | Donovan et al. |
| 5,236,843 | A | 8/1993 | Narva et al. |
| 5,281,530 | A | 1/1994 | Sick et al. |
| 5,322,687 | A | 6/1994 | Donovan et al. |
| 5,356,623 | A | 10/1994 | Von Tersch et al. |
| 5,378,625 | A | 1/1995 | Donovan et al. |
| 5,407,825 | A | 4/1995 | Payne et al. |
| 5,424,409 | A | 6/1995 | Ely et al. |
| 5,530,195 | A | 6/1996 | Kramer et al. |
| 5,593,881 | A | 1/1997 | Thompson et al. |
| 5,616,319 | A | 4/1997 | Donovan et al. |
| 5,670,365 | A | 9/1997 | Feitelson |

(Continued)

FOREIGN PATENT DOCUMENTS

| | | | |
|---|---|---|---|
| AU | 2001285900 | B2 | 2/2005 |
| AU | 784649 | B2 | 5/2006 |

(Continued)

OTHER PUBLICATIONS

Nishiwaki et al. "Cloning, Functional Characterization, and Mode of Action of a Novel Insecticidal Pore-Forming Toxin, Sphaericolysin, Produced by Bacillus sphaericus", Applied and Environmental Microbiology, May 2007, p. 3404-3411 (Year: 2007).*

(Continued)

*Primary Examiner* — Lianko G Garyu

(74) *Attorney, Agent, or Firm* — Honigman LLP; Fernando Alberdi; Jonathan P. O'Brien

(57) ABSTRACT

A peptide comprised of either a binary or a tertiary peptide, the peptide contains at least 4 amino acids and up to a maximum of 16 amino acids, comprised of 2 or 3 different regions, wherein the binary peptides have 2 different regions and the tertiary peptides have 3 different regions; wherein, the peptide can be cleaved by both an animal gut protease and an insect or nematode gut protease.

16 Claims, 9 Drawing Sheets

Specification includes a Sequence Listing.

(56) References Cited

U.S. PATENT DOCUMENTS

| | | | |
|---|---|---|---|
| 5,679,343 | A | 10/1997 | Donovan et al. |
| 5,683,691 | A | 11/1997 | Peferoen et al. |
| 5,723,756 | A | 3/1998 | Peferoen et al. |
| 5,723,758 | A | 3/1998 | Payne et al. |
| 5,743,477 | A | 4/1998 | Walsh et al. |
| 5,753,492 | A | 5/1998 | Schnepf et al. |
| 5,763,568 | A | 6/1998 | Atkinson et al. |
| 5,824,792 | A | 10/1998 | Payne et al. |
| 5,831,011 | A | 11/1998 | Payne et al. |
| 5,837,237 | A | 11/1998 | Peferoen et al. |
| 5,874,288 | A | 2/1999 | Thompson et al. |
| 5,932,209 | A | 8/1999 | Thompson et al. |
| 5,942,664 | A | 8/1999 | Baum et al. |
| 5,959,182 | A | 9/1999 | Atkinson et al. |
| 5,973,231 | A | 10/1999 | Bradfisch et al. |
| 5,985,831 | A | 11/1999 | Bradfisch et al. |
| 6,028,246 | A | 2/2000 | Lambert et al. |
| 6,043,415 | A | 3/2000 | Strizhov et al. |
| 6,048,839 | A | 4/2000 | Bradfisch et al. |
| 6,063,605 | A | 5/2000 | Ely et al. |
| 6,063,756 | A | 5/2000 | Donovan et al. |
| 6,077,937 | A | 6/2000 | Payne et al. |
| 6,096,708 | A | 8/2000 | Payne et al. |
| 6,107,278 | A | 8/2000 | Schnepf et al. |
| 6,143,550 | A | 11/2000 | Lambert et al. |
| 6,150,165 | A | 11/2000 | Payne et al. |
| 6,150,589 | A | 11/2000 | Payne et al. |
| 6,156,573 | A | 12/2000 | Malvar et al. |
| 6,166,195 | A | 12/2000 | Schnepf et al. |
| 6,172,281 | B1 | 1/2001 | Van Mellaert et al. |
| 6,320,100 | B1 | 11/2001 | Koziel et al. |
| 6,326,351 | B1 | 12/2001 | Donovan et al. |
| 6,399,330 | B1 | 6/2002 | Donovan et al. |
| 6,448,226 | B1 | 9/2002 | Lambert et al. |
| 6,468,523 | B1 | 10/2002 | Mettus et al. |
| 6,537,756 | B1 | 3/2003 | Rupar et al. |
| 6,570,005 | B1 | 5/2003 | Schnepf et al. |
| 6,573,240 | B1 | 6/2003 | Payne et al. |
| 6,583,264 | B2 | 6/2003 | King et al. |
| 6,686,452 | B2 | 2/2004 | Rupar et al. |
| 6,727,409 | B1 | 4/2004 | Lambert et al. |
| 6,780,408 | B1 | 8/2004 | Bosch et al. |
| 6,784,337 | B1 | 8/2004 | Atkinson et al. |
| 6,831,062 | B2 | 12/2004 | Thompson et al. |
| 6,855,873 | B1 | 2/2005 | Van Mellaert et al. |
| 6,949,626 | B2 | 9/2005 | Donovan et al. |
| 6,962,705 | B2 | 11/2005 | Malvar et al. |
| 7,019,197 | B1 | 3/2006 | Christou et al. |
| 7,208,474 | B2 | 4/2007 | Bermudez et al. |
| 7,214,788 | B2 | 5/2007 | Guzov et al. |
| 7,244,880 | B2 | 7/2007 | Arnaut et al. |
| 7,250,501 | B2 | 7/2007 | Malvar et al. |
| 7,279,547 | B2 | 10/2007 | King et al. |
| 7,304,206 | B2 | 12/2007 | Malvar et al. |
| 7,355,099 | B2 | 4/2008 | Carozzi et al. |
| 7,361,808 | B2 | 4/2008 | Boets et al. |
| 7,595,173 | B2 | 9/2009 | Krebs et al. |
| 7,943,819 | B2 | 5/2011 | Baum et al. |
| 8,993,295 | B2 | 3/2015 | Seed et al. |
| 9,567,381 | B2 | 2/2017 | Kennedy et al. |
| 2001/0010932 | A1 | 8/2001 | Schnepf et al. |
| 2001/0026939 | A1 | 10/2001 | Rice et al. |
| 2001/0026941 | A1 | 10/2001 | Held et al. |
| 2002/0152496 | A1 | 10/2002 | Fischhoff et al. |
| 2003/0017967 | A1 | 1/2003 | Asano et al. |
| 2003/0046726 | A1 | 3/2003 | Koziel et al. |
| 2003/0054391 | A1 | 3/2003 | Bulla, Jr. |
| 2003/0134310 | A1* | 7/2003 | Cujec .................... C12Q 1/485 435/6.14 |
| 2003/0144192 | A1 | 7/2003 | Donovan et al. |
| 2003/0167517 | A1 | 9/2003 | Arnaut et al. |
| 2003/0167522 | A1 | 9/2003 | Narva et al. |
| 2003/0229919 | A1 | 12/2003 | Isaac et al. |
| 2004/0018982 | A1 | 1/2004 | Schnepf et al. |
| 2004/0033523 | A1 | 2/2004 | English et al. |
| 2004/0058860 | A1 | 3/2004 | Payne et al. |
| 2004/0093637 | A1 | 5/2004 | Malvar et al. |
| 2004/0123343 | A1 | 6/2004 | La Rosa et al. |
| 2004/0194165 | A1 | 9/2004 | Payne et al. |
| 2005/0091714 | A1 | 4/2005 | Sunchis et al. |
| 2005/0097635 | A1 | 5/2005 | Lambert et al. |
| 2005/0227321 | A1 | 10/2005 | Krebs et al. |
| 2006/0051822 | A1 | 3/2006 | Donovan et al. |
| 2006/0174372 | A1 | 8/2006 | Malvar et al. |
| 2006/0218666 | A1 | 9/2006 | Isaac et al. |
| 2006/0242734 | A1 | 10/2006 | King et al. |
| 2007/0061919 | A1 | 3/2007 | Baum et al. |
| 2007/0074308 | A1 | 3/2007 | Boets et al. |
| 2007/0163000 | A1 | 7/2007 | Rupar et al. |
| 2007/0208168 | A1 | 9/2007 | Guzov et al. |
| 2007/0245430 | A1 | 10/2007 | Abad et al. |
| 2007/0277263 | A1 | 11/2007 | Anderson et al. |
| 2008/0016596 | A1 | 1/2008 | Abad et al. |
| 2008/0020968 | A1 | 1/2008 | Abad et al. |
| 2008/0040827 | A1 | 2/2008 | Donovan et al. |
| 2008/0047034 | A1 | 2/2008 | Arnaut et al. |
| 2009/0099081 | A1 | 4/2009 | Carozzi et al. |
| 2009/0183278 | A1 | 7/2009 | Abad et al. |
| 2010/0055761 | A1 | 3/2010 | Seed et al. |
| 2015/0148288 | A1 | 5/2015 | Kennedy et al. |

FOREIGN PATENT DOCUMENTS

| | | | |
|---|---|---|---|
| CA | 2410153 | A1 | 6/2004 |
| CN | 1199569 | A | 11/1998 |
| CN | 1260397 | A | 7/2000 |
| CN | 1366822 | A | 9/2002 |
| CN | 1401772 | A | 3/2003 |
| CN | 1942582 | A | 4/2007 |
| CN | 1952151 | A | 4/2007 |
| CN | 101003789 | A | 7/2007 |
| CN | 106367361 | B | 8/2019 |
| EP | 1681351 | A1 | 7/2006 |
| JP | 2005139167 | A | 6/2005 |
| JP | 2007006895 | A | 1/2007 |
| JP | 2009286708 | A | 12/2009 |
| MX | 199606262 | A | 1/1998 |
| MX | PA01004361 | A | 6/2003 |
| MX | PA02008705 | A | 12/2004 |
| MX | PA03006130 | A | 2/2005 |
| RU | 2278161 | C1 | 6/2006 |
| UA | 75317 | C2 | 4/2006 |
| WO | 1991000915 | A1 | 1/1991 |
| WO | 1995034656 | A1 | 12/1995 |
| WO | 199840490 | A1 | 9/1998 |
| WO | 199840491 | A2 | 9/1998 |
| WO | 2001014562 | A1 | 3/2001 |
| WO | 2001034811 | A2 | 5/2001 |
| WO | 2001047952 | A2 | 7/2001 |
| WO | 2002014517 | A1 | 2/2002 |
| WO | 2002015701 | A2 | 2/2002 |
| WO | 2003042369 | A2 | 5/2003 |
| WO | 20131166211 | A2 | 5/2003 |
| WO | 2003082910 | A1 | 10/2003 |
| WO | 2004016653 | A2 | 2/2004 |
| WO | 2004020636 | A1 | 3/2004 |
| WO | 2005066202 | A2 | 7/2005 |
| WO | 2005082077 | A2 | 9/2005 |
| WO | 2006052806 | A2 | 5/2006 |
| WO | 2006053473 | A1 | 5/2006 |
| WO | 2007027776 | A2 | 3/2007 |
| WO | 2007045160 | A1 | 4/2007 |
| WO | 2007062064 | A2 | 5/2007 |
| WO | 2007087567 | A2 | 8/2007 |
| WO | 2007107302 | A2 | 9/2007 |
| WO | 2008036138 | A2 | 3/2008 |
| WO | 2008132743 | A2 | 11/2008 |
| WO | 2008153551 | A1 | 12/2008 |
| WO | 2009155557 | A2 | 12/2009 |
| WO | 2010039652 | A2 | 4/2010 |
| WO | 2010133644 | A2 | 11/2010 |
| WO | 2011084634 | A1 | 7/2011 |
| WO | 2012038950 | A1 | 3/2012 |
| WO | 2013040142 | A2 | 3/2013 |

(56) References Cited

FOREIGN PATENT DOCUMENTS

| | | | | | |
|---|---|---|---|---|---|
| WO | 2013134734 | A2 | | 9/2013 | |
| WO | 2014200910 | A2 | | 12/2014 | |
| WO | WO-2014200910 | A2 | * | 12/2014 | ............ G16B 20/00 |
| WO | 2018207036 | A1 | | 11/2018 | |
| WO | 2000026371 | A1 | | 5/2020 | |

OTHER PUBLICATIONS

Fitches et al., "Fusion proteins containing insect-specific toxins as pest control agents: snowdrop lectin delivers fused insecticidal spider venom toxin to insect haemolymph following oral ingestion" Journal of Insect Physiology, Jan. 2004, pp. 61-71 (Year: 2004).*
International Search Report and Written Opion for PCT Application No. PCT/US2017/055596, dated Feb. 1, 2018, 13 pages.
Sainsbury et al., "Multimodal Protein Constructs for Herbivore Insect Control," Toxins, Jun. 12, 2012, pp. 455-475, vol. 4, No. 6.
Chambaud I et al: "The complete genome sequence of the murine respiratory pathogen Mycoplasma pulmonis", Nucleic Acids Research, Information Retrieval LTD vol. 29, No. 10, Jan. 1, 2001 (Jan. 1, 2001), pp. 2145-2153.
De Dianous et al., "The Effect of the Mode of Application on the Toxicity of Androctonus australis Hector Insect Toxin", Pestic. Sci., 23:35-40, 1988.
Guo et al., "Fractionation and identification of Alaska pollock skin collagen-derived mineral chelating peptides" Food Chemistry 173: 536-542, 2015.
Hallquiist et al., "Lipopolysaccharide regulates cysteine-rich intestinal protein, a zincfinger protein, in immune cells and plasma", Journal of Leukocyte Biology, 59(2):172-177, 1996 (abstract only).
Harris et al., "Rapid and general profiling of protease specificity by using combinatorial fluorogenic substrate libraries", PNAS, 97(14):7754-7759, 2000.
Seltzer et al., "Cleavage Specificity of Human Skin Type IV Collagenase (Gelatinase)," The Journal of Biological Chemistry 265(33): 20409-20413, 1990.
Tabashnik et al., "Insect resistance to Bt crops: lessons from the first billion acres", Nature Biotechnology, 31(6):510-521, 2013.
Tyndall et al., "Proteases Universally Recognize Beta Strands in Their Active Sites", Chem. Rev., 105:973-999, 2005.
UniProt entry MYPU_2440, 2001.
UniProt entry X1P169, 2014.
Walters et al., "An Engineered Chymotrypsin/Cathepsin G Site in Domain I Renders Bacillus thuringiensis Cry3A Active against Western Corn Rootworm Larvae", Applied and Environmental Microbiology, 74(2):367-374, 2008.
Anonymous: GSP: BAY44659, Retrieved from the Internet: 1-4 URL:http://ibis.internal.epo.org/exam/dbfetch.jsp?id= GSP:BAY44659 [retrieved on Oct. 15, 2020], 1 page.
European Extended Search Search for EP Application No. 17862582.8, dated Oct. 26, 2020, pp. 22.
Angsuthanasombat et al., "Directed Mutagenesis of the Bacillus Thuringiensis Cry11A Toxin Reveals a Crucial Role in Larvicidal Activity of Arginine-136 in Helix 4," Journal of Bichemistry and Molecular Biology, Sep. 2001, vol. 34, No. 5, pp. 402-407.
Aronson et al., "Why Bacillus thuringiensis insecticidal toxins are so effective: unique feaures of their mode of action," FEMS Microbiology Letters, 2001, vol. 195, pp. 1-8.
De Maagd et al., "Identification of Bacillus Thuringiensis Delta-Endotoxin Cry1C Domain III Amino Acid Residues Involved in Insect Specificity," Applied and Environmental Microbiology, Oct. 1999, vol. 65, No. 10, pp. 4369-4374.
De Maaged et al., "How Bacillus thuringiensis has evolved specific toxins to colonize the insect world," Trends in Genetics, Apr. 2001, vol. 17, No. 4, pp. 193-199.
Helting et al., Structure of Tetanus Toxin, "The Journal of Biologicial Chemistry," Jan. 1977, vol. 252, No. 1, pp. 187-193.
NCBI, UniProtKB/Swiss-Prot. S0F209.1, Omega/Kappa-hexatoxin-Hv1h [Hydronyche versuta], Oct. 2014, 2 pages.
Pineda et al., "Diversification of a single ancestral gene into a successful toxin superfamily in highly venomous Australian funnel-web spiders," BCM Genomics, 2014, vol. 15, pp. 177-177.
Andrews et al., "Characterization of the lipid acyl hydrolase activity of the major potato (Solanum tuberosum) tuber protein, patatin, by cloning and abundant expression in a baculovirus vector", Biochem. J., 1988, vol. 252, pp. 199-206.
Ayres et al., "Genetic Transformation of Rice", Critical Reviews in Plant Science, 1994, vol. 13, No. 3 pp. 219-239.
Barloy et al., "Cloning and Expression of the First Anaerobic Toxin Gene from *Clostridium bifermentans* subsp. Malaysia, Encodiing a New Mosquitocidal Protein with Homologies to Bscillus thuringiensis Delta-Endotoxins", J of Bacteriology, Jun. 1996, vol. 178, No. 11, pp. 3099-3105.
Barloy et al., "Distribution of Clostridial cry-Like Genes Among Bacillus thuringiensis and Clostridium Strains", Current Microbiology, 1998, vol. 36, pp. 232-237.
Benchabane et al., "Preventing unintended proteolysis in plant protein biofactories", Plant Biotechnology Journal, No. 6, 2008, pp. 633-648.
Bommineni et al., "An Evaluation of Target Cells and Tissues used in Genetic Transformation of Cereals", Maydica, Apr. 1997, vol. 42, pp. 107-120.
Borovsky et al., "Expression of Aedes trypsin-modulating oostatic factor on the virion of TMV: A potential larvicide", Proc Natl Acad Sci, Dec. 12, 2006, vol. 103, No. 50, pp. 18963-18968.
Borovsky, "Trypsin-modulating oostatic factor: a potential new larvicide for mosquito control", Journal of Experimental Biology, 2003 vol. 206, No. 21, pp. 3869-3875.
Bosmans et al., "Sea Anemone Venom as a Source of Insecticidal Peptides Acting on Voltage-Gated Na+ Channels", Toxicon, V 49, No. 4, pp. 550-560, Mar. 2007.
Broderick et al., "Midgut Bacteria Required for Bacillus Thuringiensis Insecticidal Activity", PNAS, Oct. 10, 2006, vol. 103, No. 41., pp. 15196-15199.
Cavallini, "Biological Action of Two Tomato Cysteine-Rich Miniproteins", PhD. Thesis; Dept of Biotechnology University of Verona, 2010; retrieved from the internet: URL: http://www.univr.it/documenti/AllegaiOA/allegatooa_5484.pdf.
Chang et al., "De novo folding of GFP fusion proteins: high efficiency in eukaryotes but not in bacteria", Journal of Molecular Biology, Oct. 21, 2005, vol. 353, No. 2, pp. 397-409.
Chen et al., "Signal peptide-dependent targeting of a rice alpha-amylase and cargo proteins to plastids and extracellular compartments of plant cells", Plant Physiology, Jul. 2004, vol. 135, No. 3, pp. 1367-1377.
Cohen, "Biological Control A Guide to Natural Enemies in North America, Anthony P. Shelton, Professor of Entomology, Cornell University", as an update dated "Last updated Feb. 25, 2015" by Zachary P. Cohen, Cornell University.
Crickmore et al., "Revision of the Nomenclature for the Bacillus thuringiensis Pesticidal Crystal Proteins", Microbiology and Molecular Biology Reviews, vol. 62, No. 3, Sep. 1998, pp. 807-813.
Czapla et al., "Effect of Plant Lectins on the Larval Development of Europran Corn Borer (Lepidoptera: Pyralidae) and Southern Corn Rootworm (Coleoptera: Chrysomelidae)", J. Econ. Entomol., Dec. 1990, vol. 83, No. 6, pp. 2480-2485.
Daskalova et al., "Engineering of *N. benthamiana* L. plants for production of N-acetylgalactosamine-glycosylated proteins", BMC Biotechnology, Aug. 24, 2010, vol. 10, No. 62.
Dauplais, "On the convergent evolution of animal toxins", Journal of Biological Chemistry, Feb. 14, 1997; vol. 272, No. 7, pp. 4302-4309.
De Loose et al., "The extensin signal peptide allows secretion of a heterologous protein from protoplasts", Gene, 1991, vol. 99, pp. 95-100.
Down et al., "Insecticidal Spider Venom Toxin Fused to Snowdrop Lectin is Toxic to the Peach-potato Aphid, Myzus Persicae (Hemiptera: Aphididae) and the Rice Brown Planthopper, Nilaparvata Lugens (Hemiptera: Delphacidae)", Pest Manag. Sci., Jan. 2006, vol. 62, pp. 77-85.

(56) References Cited

OTHER PUBLICATIONS

Escoubas et al., "Structure and pharmacology of spider venom neurotoxins", Biochimie, vol. 82, Issues 9-10, Sep. 10, 2000, pp. 893-907.
Figueiredo et al., "Heterologous Expression of an Insecticidal Gene from the Armed Spider (Phoneutria Nigriventer)", Journal of Venomous Animals and Toxins Including Tropical Diseases, vol. 14, No. 2, pp. 274-293, 2008.
Fitches et al., "An evaluation of garlic lectin as an alternative carrier domain for insecticidal fusion proteins", Insect Science, 2008, vol. 15, pp. 483-495.
Fitches et al., "The insecticidal activity of recombinant garlic lectins towards aphids", Insect Biochem. Mol. Biol., 2008, vol. 38, pp. 905-915.
Fletcher et al., "The Structure of a Novel Insecticidal Neurotoxin, w-atracotoxin-HV1, from the venom of an Australian funnel web spider", Nature Structural Biology vol. 4, No. 7, pp. 559-566, 1997.
Galvez et al., "Purification and characterization of a unique, potent, peptidyl probe for the high conductance calcium-activated potassium channel from venom of the scorpion Buthus tamulus", Journal of Biological Chemistry, Jul. 5, 1990; vol. 265, No. 19, pp. 11083-11090.
Gimenez-Gallego et al., "Purification, sequence, and model structure of charybdotoxin, a potent selective inhibitor of calcium-activated potassium channels", Proc. Nat. Acad Sci., May 1988, vol. 85, No. 10, pp. 3329-3333.
Gressent et al., "Pea Albumin 1 Subunit b (PA1b), a Promising Bioinsecticide of Plant Origin", Toxins, vol. 3, No. 12, pp. 1502-1517, Dec. 2011.
Heath et al., "Characterization of the protease processing sites in a multidomain proteinase inhibitor precursor from Nicotiana alata", European Journal of Biochemistry, 1995, vol. 230, pp. 250-257.
Hellens et al., "A Guide to Agrobacterium Binary Ti Vectors", Trends in Plant Science, Oct. 2000, vol. 5, No. 10 pp. 446-451.
Hernandez-Campuzano, et al., Expression of a spider venom peptide in transgenic tobacco confers insect resistance, Toxicon, 2009, vol. 53, No. 1, pp. 122-128.
Hiel, et al., Efficient transformation of rice (*Oryza sativa* L.) mediated by Agrobacterium and sequence analysis of the boundaries of the T-NDA, The Plant Journal, 1994, vol. 6, No. 2, pp. 271-282.
Hofte et al., "Insecticidal Crystal Proteins of Bacillus thuringiensis". Microbiological Reviews, vol. 53, No. 2, Jun. 1989, pp. 242-255.
Ishida et al., "High efficiency transformation of maize (*Zea mays* L.) mediated by Agrobacterium tumefaciens", Nature Biotechnology, Jun. 1996, vol. 14, pp. 745-750.
Jennings et al., "Biosynthesis and insecticidal properties of plant cyclotides: The cyclic knotted proteins from Oldenlandia affinis", PNAS, 98(19):10614-10619, 2001.
Jones et al., The Cys-Loop Ligand-Gated Ion Channel Gene Superfamily of the Nematode, Caenorhabditis Elegans; Invert Neurosci, 2008, vol. 8, pp. 41-47.
Khan et al., "Spider venom toxin protects plants from insect attack", Transgenic Research, 2006, vol. 15, pp. 349-357.
Kramer et al., "Sequence of a cDNA and expression of the gene encoding epidermal and gut chitinases of Manduca sexta", Insect Biochemistry and Molecular Biology, Sep. 1993, vol. 23, Issue 6, pp. 691-701.
Kumari et al., "Cysteine-Rich Peptide Family with Unusual Disulfide Connectivity from Jasminum sambac", Journal of Natural Products, 78:2791-2799, 2015.
Kwok et al., "GFP-labelled Rubisco and aspartate aminotransferase are present in plastid stromules and traffic between plastids", Journal of Experimental Botany, Mar. 2004, vol. 55, No. 397, pp. 595-604.
Lambert et al., "A Bacillus thuringiensis Insecticidal Crystal Protein with a High Activity against Members of the Family Noctuidae", Applied & Environmental Microbiology, Jan. 1996, vol. 62, No. 1, pp. 80-86.
Lew et al., "Structure-Function Relationships of ?-Conotoxin GVIA" Journal of Biological Chemistry, 1997, vol. 272, No. 18, pp. 12014-12023.
Li et al., "Expression and Characterization of a Recombinant Cry1Ac Crystal Protein Fused with an Insect-Specific Neurotoxin ?-ACTX-Hv1a in Bacillus Thuringiensis", Gene (Amsterdam), V 498, No. 2, pp. 323-327, Feb. 2012.
Marrone et al., "Improvements in Laboratory Rearing of the Southern Corn Rootworm, Diabrotica Undecimpuncta Howardi Barber (Coleoptera: Chrysomelidae), on an Artifical Diet and Corn", J. of Economic Entomology, 1985, vol. 78, pp. 290-293.
Martinez et al., "Toxin III From Anemonia-Sulcata Primary Structure", Febs Letters, V 84, No. 2, pp. 247-252; 1977.
McBride et al., "Controlled Expression of Plastid Transgenes in Plants Based on a Nuclear DNA-Encoded and Plastid-Targeted T7 RNA Polymerase", Proc. Natl. Acad. Sci., Jul. 1994, vol. 91, pp. 7301-7305.
McCormick et al., "Leaf Disc Transformation of Cultivated Tomato (*L. esculentum*) using Agrobacterium Trumefaciens", Plant Cell Reports, 1986, vol. 5, pp. 81-84.
Memelink et al., "Structure and Regulatiom of Tobacco Extensin", The Plant Journal, 1993, vol. 4, pp. 1011-1022.
Midoro-Horiuti et al., "Variable Expression of Pathogenesis-Related Protein Allergen in Mountain Cedar (Juniperas ashei) Pollen", J Immunol, 164(4):2188-2192, 2000.
Moran et al., "Molecular analysis of the sea anemone toxin Av3 reveals selectivity to insects and demonstrates the heterogeneity of receptor site-3 on voltage-gated Na+ channels", Biochem. J., 406:41-48, 2007.
Mukherjee et al., "Orally active acaricidal peptide toxins from spider venom", Toxicon, 2006, vol. 47, pp. 182-187.
Norton et al., "The Cystine Knot Structure of Ion Channel Toxins and Related Polypeptides", Toxicon, vol. 36, No. 11, pp. 1573-1583, 1998.
PCT International Search Report for PCT/US2013/030042, dated Oct. 28, 2013.
Peña et al., "A Bacillus thuringiensis S-Layer Protein Involved in Toxicity against Epilachna varivestis (Coleoptera: Coccinellidae)", App & Environ Microbiology, Jan. 2006, vol. 72, No. 1, pp. 353-360.
Pence, "The antimetabolite imidazole as a pesticide", California Agric., Jan. 1965, pp. 13-15.
Pogue et al., "Production of Pharmaceutical-Grade Recombinant Aprotinin and a Monoclonal Antibody Product Using Plant-Based Transient Expression Systems", Plant Biotechnology Journal, 2010, vol. 8, pp. 638-654.
Quintero-Hernandez et al., "Scorpion and Spider Venom Peptides: Gene Cloning and Peptide Expression", Toxicon, 2011, vol. 58, pp. 644-663.
Raymond et al., "The impact of strain diversity and mixed infections on the evolution of resistance to Bacillus thuringiensis", Proceedings of the RoyalSociety B, 2013, 280:1-9. http://dx.doi.org/10.1098/rspb.2013.1497.
Rowell et al., "Bt Basics for Vegetable Integrated Pest Management", University of Kentucky—College of Agriculture, UK Cooperative Extension Service, Jul. 2005.
Sambrook and Russell, Molecular Cloning: A Laboratory Manual, 2001, Table of Contents.
Sathasivan, et al., Nucleotide sequence of a mutant acetolactate synthase gene from an imidazolinone-resistant *Arabidopsis thaliana* var. Columbia, Nucl. Acids Res., 1990, vol. 18, No. 8, p. 2188.
Shi et al., "Construction of Plant Expression Vector of Fusion Gene Ubiquitin and Signal peptide Sequence of Pathogenesis-related Protein 1a", Journal of Shihezi University (Natural Science), 2006, vol. 24, No. 3, pp. 265-269.
Shim et al., "NeuroBactrus, a Novel, Highly Effective, and Environmentally Friendly Recombinant Baculovirus Insecticide," Applied and Enviommental Michrobiology, 2013, vol. 79, No. 1, pp. 141-149.
Shu et al., "Current Patents Related to Bacillus thuringiensis Insecticidal Crystal Proteins", Recent Patents on DNA & Gene Sequences, 2009, vol. 3, No. 1, pp. 26-28.

(56) References Cited

OTHER PUBLICATIONS

Stalker et al., Purification and Properties of a Nitrilase Specific for the Herbicide Bromoxynil and Corresponding Nucleotide Sequence Analysis of the bxn Gene, J. Biol. Chem., May 5, 1988, vol. 263, No. 13, pp. 6310-6314.
Staub et al., "Accumulation of D1 polypeptide in tabacco plastids is regulated via the untranslated region of the psbA mRNA", EMBO J., 1993, vol. 12, No. 2 pp. 601-606.
Svab et al., "High-frequency plastid transformation in tobacco by selection for a chimeric aadA gene", Proc. Natl. Acad. Sci., Feb. 1993, vol. 90, pp. 913-917.
Svab et al., "Stable Transformation of Plastids in Higher Plants", Proc. Natl. Acad. Sci., Nov. 1990, vol. 87, pp. 8526-8530.
Takahashi et al., "Solution structure of hanatoxin1, a gating modifier of voltage-dependent K+ channels: common surface features of gating modifier toxins", Journal of Molecular Biology, Mar. 31, 2000, vol. 297, Issue 3, pp. 771-780.
Van Damme et al., "Biosynthesis, primary structure and molecular cloning of snowdrop (*Galanthus nivalis* L.) lectin", European Journal of Biochemistry, 1991, vol. 202, pp. 23-30.
Yokoyama et al., Novel cry gene from Paenibacillus lentimorbus strain Semadara inhibits ingestion and promotes insecticidal activity in Anomala cuprea larvae, J of Invertebrate Pathology, 2004, vol. 85, pp. 25-32.
Zhang et al., "Cloning and Analysis of the First cry Gene from Bacillus popilliae", J of Bacteriology, Jul. 1997, vol. 179, No. 13, pp. 4336-4341.
Zhu et al., "Evolutionary origin of inhibitor cystine knot peptides", FASEB Jour., Sep. 2003, vol. 17, pp. 1765-1767.
Zimmerman et al., "Protein translocation across the ER membrane", Biochimica et Biophysica Acta, 2011, vol. 1808, pp. 912-924.
Tounsi et al., "Cloning and study of the expression of a novel cry1Ia-type gene from *Bacillus thuringiensis* subsp. Kurstaki," J. Appl. Microbial., 2003, vol. 95, No. 1, pp. 23-28.
Fitches et al., "Fusion proteins containing insect-specific toxins as pest control agents: snowdrop lectin delivers fused insecticidal spider venom toxin to insect haemolymph following oral ingestion", J. Insect Physiol., Jan, 2004, vol. 50, pp. 61-71.
Guo, et al., "Protein tolerance to random amino acid change," PNAS, Jun. 2004, vol. 101, No. 25, pp. 9205-9210.
Ostergaard et al., "Increasing galactose consumption by *Saccharomyces cerevisiae* through metabolic engineering of the GAL gene regulatory network," Nature Biotechnology, 2000, vol. 18, pp. 1283-1286.
Ostergaard et al., "Physiological Studies in Aerobic Batch Cultivations of *Saccharomyces cerevisiae* Strains Harboring the Mel1," Biotechnology and Bioengineering, 2000, vol. 68, No. 3, pp. 252-259.
Petit et al., "Structure/function study of an entomotox albumin type A1b pea in rice; application to protection against the pest of stock Sitophilus Oryzae", PH.D, Dissertation, Dec. 20, 2006, University of Montpellier II.
Alpha-glactosidase 1, MEL1 UniProt P04824, Retrieved from < https://www.uniprot.org/uniprot/P04824 > on Apr. 6, 2022.
Gill, G. et al., "Mutants of GAL4 Protein Altered in an Activation Function", Cell, 1987, vol. 51, pp. 121-126.
Guardia, C. et al., "Structural basis of redox-dependent modulation of galectin-1 dynamics and function," Glycobiology, 2014, vol. 24, No. 5, pp. 424-441.
Yu, J. et al., "Glutathionylation-triggered conformational changes of glutaredoxin Grx1 from the yeast *Saccharomyces cerevisiae*," Proteins, 2008, vol. 72, No. 3, pp. 1077-1083.

* cited by examiner

CLEAVABLE PEPTIDES AND INSECTICIDAL AND NEMATICIDAL PROTEINS COMPRISING SAME

CROSS REFERENCE TO RELATED APPLICATIONS

This application claims priority to PCT International Application No. PCT/US2017/055596, filed Oct. 6, 2017, which claims the benefit of, and priority to, U.S. Provisional Application Ser. No. 62/411,117, filed on Oct. 21, 2016. The entire contents of these applications are incorporated herein by reference in their entirety.

SEQUENCE LISTING

This application incorporates by reference in its entirety the Sequence Listing entitled "FAM_O_US-PCT_225312_448705_SEQ_LIST_2019_11_19_ST25.txt" (5.36 MB), which was amended on Nov. 19, 2019, and filed electronically herewith.

FIELD OF THE INVENTION

New insecticidal and nematicidal proteins, cleavable peptides, DNA constructs encoding same, transgenic proteins, their expression in plants, methods of producing the transgenic proteins, new processes, production techniques, new peptides, new formulations, and combinations of new and known insecticidal and nematicidal proteins contained within transgenic proteins that produce greater pest resistance than would be expected of related insecticidal and nematicidal proteins for the control of insects and nematodes are described and claimed.

BACKGROUND

The global security of food produced by modern agriculture and horticulture is challenged by insect pests. Farmers rely on insecticides to suppress insect damage, yet commercial options for safe and functional insecticides available to farmers are diminishing through the removal of dangerous chemicals from the marketplace and the evolution of insect strains that are resistant to all major classes of chemical and biological insecticides. New insecticides are necessary for farmers to maintain crop protection.

Insecticidal and nematicidal peptides, polypeptides and proteins are peptide and protein polymers that are toxic to their targets, usually insects or nematodes. The insecticidal peptides or toxins commonly derive from arthropod origins such as from scorpions or spiders. The toxins can be delivered directly to the insect's gut or internal organs by injection or by inducing the insect to consume the toxin from its food, for example an insect feeding upon a transgenic plant. These toxins have been known to have the ability to inhibit the growth, impair the movement, or even kill an insect when the toxin is delivered to the insect by spreading the toxin to the locus inhabited by the insect or to the insect's environment by spraying, or other means. Through direct exposure, or ingestion, the insect comes into some form of contact with the toxic peptide, polypeptide or protein.

Insecticidal peptides however have enormous problems reaching the commercial market and to date there have been few if any insecticidal peptides approved and marketed for the commercial market, with one notable exception, peptides derived from *Bacillus thuringiensis* or Bt. There is presently, great concern over rising insect resistance to Bt proteins.

Bt proteins, or Bt peptides, are effective insecticides used for crop protection in the form of both plant incorporated protectants and foliar sprays. Commercial formulations of Bt proteins are widely used to control insects at the larval stage. Inhibitory cysteine knot motif (ICK) proteins are also a class of insecticidal peptides which are derived from arthropod origins, such as the venoms of scorpions or spiders.

Other classes and types of potential peptides have been identified, such as Trypsin modulating oostatic factor (TMOF) peptides. TMOF peptides have to be delivered to their physiological site of action for insecticidal activity to ensue. TMOF peptides have been identified as potential larvicides, with great potential, see D. Borovsky, Journal of Experimental Biology 206, 3869-3875, but like nearly all other insecticidal peptides, TMOF has not been commercialized or widely used by farmers and there are reasons for this.

The ability to successfully produce insecticidal peptides on a commercial scale, with reproducible peptide formation and folding, at a reasonable and economical price, can be a significant obstacle to commercialization. The wide variety, unique properties and special nature of insecticidal peptides, combined with the huge variety of possible production techniques, can present an overwhelming number of approaches to peptide application and production, but few, if any, are commercially successful.

There are several reasons why so few of the multitude insecticidal peptides that have been identified have ever made it to market. First, most insecticidal peptides are either too delicate or not toxic enough to be used commercially. Second, insecticidal peptides are difficult and costly to produce commercially. Third, many insecticidal peptides quickly degrade and have a short half-life. Fourth, very few insecticidal peptides fold properly when then are expressed by a plant, thus they lose their toxicity in genetically modified organisms (GMOs) such as genetically modified plants. Fifth, most of the identified insecticidal peptides are blocked from systemic distribution in the insect and/or lose their toxic nature when consumed by insects. Bt proteins are an exception to this last problem and because they disrupt insect feeding they have been widely used.

The present invention provides several solutions to these major problems which have prevented commercialization and wide spread use of insecticidal peptides. The present invention provides transgenic proteins that enable the synthesis and release of insecticidal and nematicidal toxic peptides in relatively large numbers at the site of activity, i.e., the gut or other organs of the insect or nematode. The synthesis in the host is facilitated by directed expression in regions of the host cell that enables proper folding of the transgenic protein and enhances synthesis in the host cell.

SUMMARY OF THE EXEMPLARY EMBODIMENTS OF THE INVENTION

The present invention provides cleavable peptides that are fused to toxic insecticidal and/or nematicidal toxic peptides and proteins that can be expressed and synthesized in a host cell, for example a plant cell that is subject to consumption by an insect or nematode pest. The cleavable peptides may be cleaved in the gut environment and/or hemolymph environment of an insect and/or nematode and in the gastrointestinal system of a human being thereby releasing its payload comprising one or more insecticidal and/or nematicidal toxic peptides and proteins.

In a first aspect, the present invention provides cleavable peptides comprising a binary or a tertiary peptide that contains at least 4 amino acids and up to a maximum of 16 amino acids, comprised of 2 or 3 different regions. In one example, the binary peptides have two different regions (an insect or nematode cleavable region and an animal (e.g. human) gut cleavable region) and the tertiary peptides have the same two regions of a binary peptide but also includes one additional region not found in a binary peptide; and wherein the binary and tertiary peptide can be cleaved by both an animal gut protease and an insect or nematode gut protease. In some embodiments, the cleavable peptides of the present invention (binary and tertiary cleavable peptides (L)) cannot be cleaved in a plant cell with an endogenous plant protease, or by a naturally occurring plant protease.

In a related embodiment, exemplary binary peptides comprise an amino acid sequence of $X_1$-$X_2$-$Y_1$-$Y_2$, $X_1$-$X_2$-$X_3$-$Y_1$-$Y_2$, $X_1$-$X_2$-$X_3$-$X_4$-$Y_1$-$Y_2$, $X_1$-$X_2$-$Y_1$-$Y_2$-$Y_3$, $X_1$-$X_2$-$X_3$-$Y_1$-$Y_2$-$Y_3$, $X_1$-$X_2$-$X_3$-$X_4$-$Y_1$-$Y_2$-$Y_3$, $X_1$-$X_2$-$Y_1$-$Y_2$-$Y_3$-$Y_4$, $X_1$-$X_2$-$X_3$-$Y_1$-$Y_2$-$Y_3$-$Y_4$, $X_1$-$X_2$-$X_3$-$X_4$-$Y_1$-$Y_2$-$Y_3$-$Y_4$, $Y_1$-$Y_2$-$X_1$-$X_2$, $Y_1$-$Y_2$-$X_1$-$X_2$-$X_3$, $Y_1$-$Y_2$-$X_1$-$X_2$-$X_3$-$X_4$, $Y_1$-$Y_2$-$Y_3$-$X_1$-$X_2$, $Y_1$-$Y_2$-$Y_3$-$X_1$-$X_2$-$X_3$, $Y_1$-$Y_2$-$Y_3$-$X_1$-$X_2$-$X_3$-$X_4$, $Y_1$-$Y_2$-$Y_3$-$Y_4$-$X_1$-$X_2$, $Y_1$-$Y_2$-$Y_3$-$Y_4$-$X_1$-$X_2$-$X_3$, $Y_1$-$Y_2$-$Y_3$-$Y_4$-$X_1$-$X_2$-$X_3$-$X_4$, wherein each $X_n$ and each $Y_n$ is an amino acid and wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

In another related aspect, a tertiary peptide of the present invention contains at least 5 amino acids up to a maximum of 16 amino acids; wherein the tertiary peptide comprises a binary peptide and a spacer of 1 to 4 amino acids. In some embodiments, the spacer comprises the amino acid sequence GS and is fused in frame to the N-terminus of a binary peptide, or to the C-terminus of the binary peptide, or both to the N-terminus and the C-terminus of a binary peptide as disclosed herein.

In a second aspect, the present invention provides an insecticidal and/or nematicidal protein having a cleavable peptide (a binary or a tertiary peptide) fused in frame with an insecticidal or nematicidal toxic protein. In another embodiment, the present invention provides an insecticidal and/or nematicidal protein having two or more cleavable peptides, wherein the insecticidal and/or nematicidal protein comprises a binary or tertiary peptide, the binary or tertiary peptide is fused in frame with a construct comprising $(TP-L)_n$, wherein n is an integer ranging from 1 to 200, or from 1 to 100, or from 1 to 10. In another embodiment, the insecticidal and/or nematicidal protein described herein comprises an endoplasmic reticulum signal peptide (ERSP) fused in frame with: a binary peptide or tertiary peptide, which is fused in frame with an insecticidal or nematicidal toxic protein and/or a repeat construct $(L-TP)_n$, or $(TP-L)_n$, wherein n is an integer ranging from 1 to 200, or from 1 to 100, or from 1 to 10. In various embodiments, an exemplary insecticidal and/or nematicidal protein can include a protein construct comprising: (ERSP)-$(TP-L)_n$, or (ERSP)-(L)-$(TP-L)_n$, or (ERSP)-$(L-TP)_n$, or (ERSP)-$(L-TP)_n$-(L), wherein n is an integer ranging from 1 to 200. In various related embodiments described above, TP is a toxic protein, L is a binary or tertiary peptide and n is an integer ranging from 1 to 200, preferably an integer ranging from 1 to 100, and more preferably an integer ranging from 1 to 10. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide. In some embodiments, the N-terminal TP is fused or unfused at its N-terminus with a binary or tertiary peptide.

In another embodiment, the present invention provides an insecticidal and/or nematicidal protein having two or more cleavable peptides, wherein the insecticidal and/or nematicidal protein comprises a stabilizing domain (STA) fused in frame with either the N-terminus of a binary or tertiary peptide, or the N-terminus of a construct comprising: $(L-TP)_n$, $(L-TP)_n$-L, $(TP-L)_n$, or L-$(TP-L)_n$. In some related embodiments, an insecticidal and/or nematicidal protein comprises an ERSP fused in frame with the N-terminus of a stabilizing domain (STA), which is fused in frame with either the N-terminus of a binary or tertiary peptide, being fused to the N-terminus of a toxic protein, or the N-terminus of a construct comprising: $(L-TP)_n$, $(L-TP)_n$-L, $(TP-L)_n$, or L-$(TP-L)_n$. In various embodiments, an exemplary insecticidal and/or nematicidal protein can include a construct comprising: (ERSP)-(STA)-$(L-TP)_n$, or (ERSP)-(STA)-$(L-TP)_n$-(L), or (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$. In some related embodiments, an insecticidal and/or nematicidal protein comprises an ERSP fused in frame with either the N-terminus of a binary or tertiary peptide, being fused to the N-terminus of a toxic protein, or the N-terminus of a construct comprising: $(L-TP)_n$, $(L-TP)_n$-L, $(TP-L)_n$, or L-$(TP-L)_n$. In various embodiments, an exemplary insecticidal and/or nematicidal protein can include a construct comprising: (ERSP)-$(L-TP)_n$, or (ERSP)-$(L-TP)_n$-(L), or (ERSP)-$(TP-L)_n$, or (ERSP)-(L)-$(TP-L)_n$. In various embodiments as described herein and above, TP is defined as a toxic protein, that is toxic to an insect and/or a nematode, L is a binary or tertiary peptide and n is an integer ranging from 1 to 200, preferably an integer ranging from 1 to 100, and more preferably an integer ranging from 1 to 10. In some embodiments, the C-terminal TP of a construct described herein and above is fused or unfused at its C-terminus with a binary or tertiary peptide. In some embodiments, the N-terminal TP is fused or unfused at its N-terminus with a binary or tertiary peptide.

In another related aspect, the present invention provides a plant, or part thereof comprising an insecticidal and/or nematicidal protein as exemplified herein. In related embodiments, the present invention provides a plant, or part thereof comprising a polynucleotide operably linked to an operable promoter for example, a homologous or heterologous promoter, in a DNA construct, for example, an expression vector, wherein the polynucleotide encodes: an insecticidal and/or nematicidal protein comprising a peptide comprising either a binary or a tertiary peptide, the binary and/or the tertiary peptide containing at least 4 amino acids and up to a maximum of 16 amino acids, and is comprised of 2 or 3 different regions, wherein the binary peptide has 2 different regions and the tertiary peptide has 3 different regions; wherein, the binary and/or the tertiary peptide can be cleaved by both an animal gut protease (for example a human gut protease) and an insect or nematode gut protease, and wherein the binary or tertiary peptide (L) is fused in frame to a toxic protein (TP). In some embodiments, the insecticidal and/or nematicidal protein comprises a repeat construct $(L-TP)_n$ or $(TP-L)_n$ wherein n is an integer ranging from 1 to 200, or from 1 to 100, or from 1 to 10. In related embodiments, the binary and/or the tertiary peptide is operably fused at its N-terminus to the C-terminus of an Endoplasmic Reticulum Signal Peptide (ERSP) and at its C-terminus operably fused to the N-terminus of a TP. See FIGS. 4, 5 and 6C. In a related embodiment, the plant or part thereof, comprises an insecticidal and/or nematicidal protein and/or a polynucleotide that encodes an insecticidal and/or nematicidal protein as exemplified herein, wherein the insecticidal and/or nematicidal protein comprises a binary or tertiary peptide, the binary or tertiary peptide is fused in frame with a construct comprising $(TP-L)_n$, or the insecticidal and/or nematicidal protein comprises a repeat construct $(L-TP)_n$, or $(TP-L)_n$, wherein n is an integer ranging from 1 to 200, or from 1 to 100, or from 1 to 10. In a related embodiment, the plant or part thereof, comprises an insecticidal and/or nematicidal protein and/or a polynucleotide that encodes an insecticidal and/or nematicidal protein as exemplified herein, wherein the insecticidal and/or nematicidal protein comprises an ERSP fused in frame with the N-terminus of a binary or tertiary peptide, the binary or tertiary peptide is fused in frame with a construct comprising $(TP-L)_n$ or the insecticidal and/or nematicidal protein comprises an ERSP fused in frame with a binary peptide and/or a repeat construct $(L-TP)_n$ or $(TP-L)_n$. See FIGS. 4, 5, and 6C. In various embodiments, the exemplary insecticidal and/or nematicidal protein can include the construct: (ERSP)-$(TP-L)_n$, or (ERSP)-(L)-$(TP-L)_n$, or (ERSP)-$(L-TP)_n$, or (ERSP)-$(L-TP)_n$-(L). In another embodiment, a plant, or part thereof comprises a polynucleotide operably linked to an operable promoter, for example, a homologous or heterologous promoter, wherein the polynucleotide encodes an insecticidal and/or nematicidal protein comprising an ERSP fused in frame with the N-terminus of a stabilizing domain (STA). See FIG. 3, FIG. 5, and FIG. 6C. The STA is fused in frame with either the N-terminus of a binary or tertiary peptide, or the N-terminus of a construct comprising: $(L-TP)_n$, $(L-TP)_n$-L, $(TP-L)_n$, or L-$(TP-L)_n$. In various embodiments, the exemplary insecticidal and/or nematicidal protein can include: (ERSP)-(STA)-$(L-TP)_n$, or (ERSP)-(STA)-$(L-TP)_n$-(L), or (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$. In various embodiments, TP is toxic protein, which may be an insecticidal protein and/or a nematicidal protein as described and exemplified in the present disclosure, L is a binary or tertiary peptide and n is an integer ranging from 1 to 200, or from 10 to 175, or from 20 to 150, or from 30 to 100, or from 40 to 100, or from 20 to 70, or from 20 to 60, or from 20 to 50, or from 20 to 40, or from 30-40. In some embodiments, n is an integer ranging from 1 to 20, or from 5 to 20, or from 10 to 20, or from 20 to 80, or from 30 to 60, or from 30 to 50 and preferably around or about or specifically 20, 25, 30, 35, 40, 45 or 50. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide.

In a third aspect, the present invention provides a method of controlling a pest infection or infestation of a plant. The method comprises providing in a diet of said pest, a plant, or part thereof, or a plant cell, said plant, part thereof, or plant cell comprising an insecticidal and/or nematicidal protein as exemplified herein, and/or a DNA construct comprising at least one polynucleotide operably linked to an operable promoter, for example, a homologous or heterologous promoter, wherein the polynucleotide encodes an insecticidal and/or nematicidal protein having one or more cleavable binary and/or tertiary peptides. In a related embodiment, the plant or part thereof, comprises a DNA construct that encodes an insecticidal and/or nematicidal protein, wherein the insecticidal and/or nematicidal protein comprises a binary or tertiary peptide which is fused in frame with a construct comprising $(TP-L)_n$ or a repeat construct $(L-TP)_n$, $(L-TP)_n$-L, $(TP-L)_n$, or L-$(TP-L)_n$ wherein n is an integer ranging from 1 to 200, or from 10 to 175, or from 20 to 150, or from 30 to 100, or from 40 to 100, or from 20 to 70, or from 20 to 60, or from 20 to 50, or from 20 to 40, or from 30-40. In some embodiments, n is an integer ranging from 1 to 20, or from 5 to 20, or from 10 to 20, or from 20 to 80, or from 30 to 60, or from 30 to 50 and preferably around or about or specifically 20, 25, 30, 35, 40, 45 or 50. In a related embodiment, the plant or part thereof, comprises a DNA construct that encodes an insecticidal and/or nematicidal protein, wherein the insecticidal and/or nematicidal protein comprises an ERSP fused in frame with the N-terminus of a binary or tertiary peptide, the binary or tertiary peptide is fused in frame with a construct comprising (TP-L)n or the insecticidal and/or nematicidal protein comprises an ERSP fused in frame with a binary peptide and/or a repeat construct $(L-TP)_n$ or $(TP-L)_n$. In various embodiments, the exemplary insecticidal and/or nematicidal protein can include: (ERSP)-$(TP-L)_n$, or (ERSP)-(L)-$(TP-L)_n$, or (ERSP)-$(L-TP)_n$, or (ERSP)-$(L-TP)_n$-(L), wherein n is an integer ranging from 1 to 200, or from 10 to 175, or from 20 to 150, or from 30 to 100, or from 40 to 100, or from 20 to 70, or from 20 to 60, or from 20 to 50, or from 20 to 40, or from 30-40. In some embodiments, n is an integer ranging from 1 to 20, or from 5 to 20, or from 10 to 20, or from 20 to 80, or from 30 to 60, or from 30 to 50 and preferably around or about or specifically 20, 25, 30, 35, 40, 45 or 50.

In another embodiment the plant or part thereof, comprises a DNA construct that encodes an insecticidal and/or nematicidal protein, wherein the insecticidal and/or nematicidal protein comprises an ERSP fused in frame with the N-terminus of a stabilizing domain (STA). The STA is fused in frame with either the N-terminus of a binary or tertiary peptide, or the N-terminus of a construct comprising: $(L-TP)_n$, $(L-TP)_n$-L, $(TP-L)_n$, or L-$(TP-L)_n$. In various embodiments, the exemplary insecticidal and/or nematicidal protein can include a construct from N-terminus to C-terminus: (STA)-$(TP-L)_n$, or (STA)-(L)-$(TP-L)_n$, or (STA)-$(L-TP)_n$, or (STA)-$(L-TP)_n$-(L), wherein n is an integer ranging from 1 to 200, or from 10 to 175, or from 20 to 150, or from 30 to 100, or from 40 to 100, or from 20 to 70, or from 20 to 60, or from 20 to 50, or from 20 to 40, or from 30-40. In some embodiments, n is an integer ranging from 1 to 20, or from 5 to 20, or from 10 to 20, or from 20 to 80, or from 30 to 60, or from 30 to 50 and preferably around or about or specifically 20, 25, 30, 35, 40, 45 or 50. In various embodiments, the exemplary insecticidal and/or nematicidal protein can include a construct from N-terminus to C-terminus: (ERSP)-(STA)-$(L-TP)_n$, or (ERSP)-(STA)-$(L-TP)_n$-(L), or (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$. In various embodiments, TP is toxic protein, L is a binary or tertiary peptide and n is an integer ranging from 1 to 200, preferably an integer ranging from 1 to 100, and more preferably an integer ranging from 1 to 10. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide. In each of the exemplified embodiments above, the pest may be an insect or a nematode as described in the present disclosure. In various embodiments, the DNA construct can be a vector, for example, a cloning vector or an expression vector containing a coding sequence comprising a polynucleotide encoding an insecticidal and/or nematicidal protein of the present invention and one or more control sequences that permits the replication and/or expression of the coding sequence in a host cell, for example, a bacterial cell, a yeast cell or a plant cell. In some of the embodiments above, the binary and/or tertiary peptides of the present invention cannot be cleaved in a plant cell by an endogenous plant protease, or by a naturally occurring plant protease.

In a fourth aspect, the present invention provides a modified toxic peptide or protein (TP) that comprises a binary or tertiary peptide inserted (e.g. fused in frame) between the active and inactive portions of the toxic peptide. In one example, a binary or tertiary peptide is inserted between the cleavable pro inactive portion of the peptide and mature active portion of the peptide. In another example, a modified toxic protein (TP) includes a stabilizing domain fused in frame with a binary or tertiary peptide of the present invention which is fused in frame with the active portion of the toxic protein (TP). In another example, the modified toxic protein (TP) is a *Bacillus thuringiensis* or *B. thuringiensis* ("Bt") derived protein, known herein as a "Bt protein" and "Bt peptide" which are used interchangeably and include peptides produced by Bt, collectively referred to herein as Bt toxic proteins or "Bt TPs". Such peptides and proteins are frequently written as "cry", "cyt" or "VIP" proteins encoded by the cry, cyt and vip genes. Bt TPs are more usually attributed to insecticidal crystal proteins encoded by the cry genes. Bt TPs are examples of PFIPS (Pore Forming Insecticidal Proteins). In various embodiments, a modified TP can include a Bt protein as described above and herein, in which the stabilizing domain (STA) is fused in frame with a binary or tertiary peptide or a construct containing one or two or more binary or tertiary peptides of the present invention. The binary or tertiary peptide is fused in frame with the active fragment of the Bt protein, such that upon exposure to the gut environment and/or hemolymph environment of an insect and/or nematode and in the gastrointestinal system of a human being, the binary or tertiary peptide is cleaved, thus separating the stabilizing or inactive portion of the TP from the active or mature form of the TP, rendering the cleaved active or mature portion insecticidal and/or nematicidal. In some embodiments, insecticidal and/or nematicidal proteins comprise a Bt TP and/or a modified Bt protein, one or more binary and/or tertiary peptides and one or more of an ERSP, and a STA as described above. In some exemplary embodiments as shown in FIG. 3B, a modified TP can include a Bt TP, for example, a cry, a cyt or a VIP protein, in which the $TP_{inactive}$ is a $Bt_{(inactive)}$ (the inactive portion of a Bt TP) and the $TP_{active}$ is a $Bt_{(active)}$ (the active portion of a Bt TP) are separated, and fused in frame with one or more binary and/or tertiary peptides designated as L as shown in FIG. 3B). Upon exposure to the gut environment and/or hemolymph environment of an insect and/or nematode and in the gastrointestinal system of an animal subject, for example a human subject, the binary or tertiary peptide is cleaved, thus separating the inactive portion of the TP from the active or mature portion of the TP, rendering the cleaved active or mature portion insecticidal and/or nematicidal in the insect and/or nematode. In some related embodiments, the modified TP as described above, for example, an exemplary Bt TP, may also optionally include an ERSP fused in frame to the N-terminal portion of the modified TP.

BRIEF DESCRIPTION OF THE DRAWINGS

As illustrated in FIG. 3B, upon exposure to the animal and insect and/or nematode gut environment, the cleavable L peptide is cleaved, thus separating the TP inactive portion and the $TP_{active}$ portion, thus liberating the active portion of the TP in the insect and/or nematode. In various embodiments, the modified TP is a Bt TP as described herein.

DETAILED DESCRIPTION OF THE INVENTION

Definitions

Figure 1:
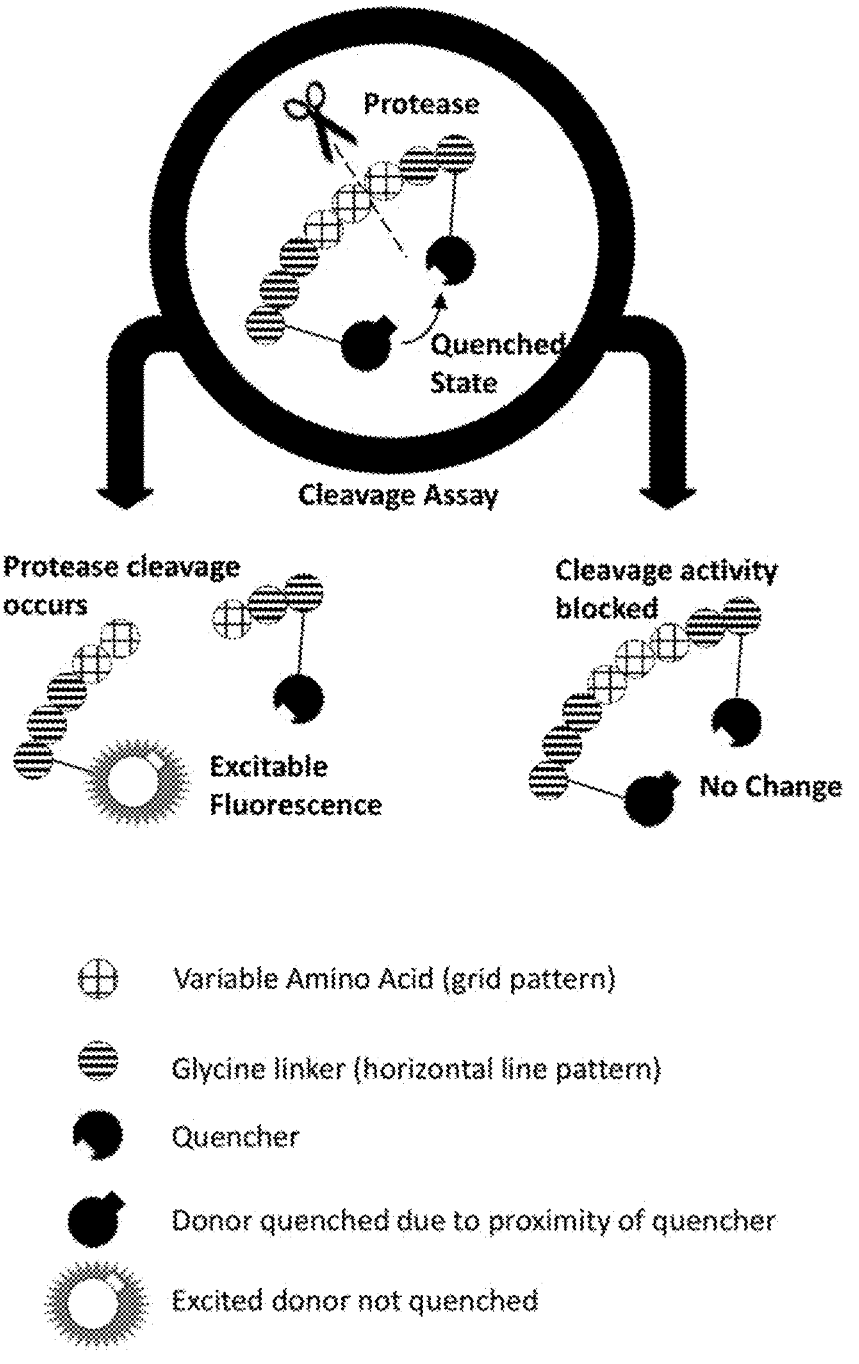
FIG. 1. Demonstration of the FRET molecules in FRET kit (Cat. No. PSREPLI005, Mimotopes) to detect the specificity of amino acid sequence based cleavage by human simulated gastrointestinal fluid (SGF) and insect gut digestive enzymes. This figure is borrowed from the Mimotopes FRET kit to illustrate how cleavage generates detectable fluorescence.

"ACTX" or "ACTX peptide" means a Family of insecticidal ICK TPs that have been isolated from an Australian funnel-web spider belonging to the Atracinae subfamily. One such spider is known as the Australian Blue Mountains Funnel-web Spider, which has the scientific name *Hydronyche versuta*. Three examples of ACTX peptides from this species are the Omega, Kappa, and U peptides.

"Agroinfection" means a plant transformation method where DNA is introduced into a plant cell by using Agrobacteria *A. tumefaciens* or *A. rhizogenes*.

"BAAS" means barley alpha-amylase signal peptide. It is an example of an ERSP.

"Binary vector" or "binary expression vector" means an expression vector which can replicate itself in both *E. coli* strains and *Agrobacterium* strains. Also, the vector contains a region of DNA (often referred to as t-DNA) bracketed by left and right border sequences that is recognized by virulence genes to be copied and delivered into a plant cell by *Agrobacterium.*

"Bt," also known as *Bacillus thuringiensis* or *B. thuringiensis*, means a gram-positive soil bacterium that has been used worldwide for more than sixty years to control agricultural, forestry, and public health insect pests.

"Bt proteins" and "Bt peptides" are used interchangeably and include peptides produced by Bt are collectively referred to herein as Bt toxic proteins or "Bt TPs". Such peptides are frequently written as "cry", "cyt" or "VIP" proteins encoded by the cry, cyt and vip genes. Bt TPs are more usually attributed to insecticidal crystal proteins encoded by the cry genes. Bt TPs are examples of PFIPS (Pore Forming Insecticidal Proteins) see definition below. Examples of PFIPS and other Bt proteins are provided in the sequence listing.

"Chimeric gene" means a DNA sequence that encodes a gene derived from portions of one or more coding sequences to produce a new gene.

"Cleavable Linker" see Linker.

"Conditioned medium" means the cell culture medium which has been used by cells and is enriched with cell derived materials but does not contain cells.

"Conversion" or "converted" refers to the process of making an HP peptide.

"CRIP" and "CRIPS" are abbreviations for Cysteine Rich Insecticidal Protein and Proteins respectively. Cysteine rich insecticidal peptides (CRIPS) are peptides rich in cysteine which form disulfide bonds. CRIPS contain at least four (4) sometimes six (6) and sometimes eight (8) cysteine amino acids among proteins or peptides having at least 10 amino acids where the cysteines form two (2), three (3) or four (4) disulfide bonds. The disulfide bonds contribute to the folding, three-dimensional structure, and activity of the insecticidal peptide. The cysteine-cysteine disulfide bonds and the three dimensional structure they form play a significant role in the toxicity of these insecticidal peptides. A CRIP is exemplified by both inhibitory cysteine knot toxic proteins or ICK TPs (usually having 6-8 cysteines) and by examples of toxic peptides having disulfide bonds but that are not considered ICK TPs (Non-ICK CRIPS). Examples of an ICK would be an ACTX peptide from a spider and defined above. Representative example of ICK proteins include U-ACTX insecticidal peptides, Omega-ACTX insecticidal peptides and Kappa-ACTX insecticidal peptides. Examples of a Non-ICK CRIP would be a peptide like Av2 and Av3 which are toxic peptides first identified from sea anemones. These peptides are examples of a class of compounds that modulate sodium channels in the insect peripheral nervous system (PNS). Non-ICK CRIPS can have 4-8 cysteines which form 2-4 disulfide bonds. These cysteine-cysteine disulfide bonds stabilized toxic peptides (CRIPS) can have remarkable stability when exposed to the environment. Many CRIPS are isolated from venomous animals such as spiders, scorpions, snakes, sea snails and sea anemones and they are toxic to insects. Additional description is provided below.

"Defined medium" means a medium that is composed of known chemical components but does not contain crude proteinaceous extracts or by-products such as yeast extract or peptone.

"Disulfide bond" means a covalent bond between two cysteine amino acids derived by the coupling of two thiol groups on their side chains.

"Double transgene peptide expression vector" or "double transgene expression vector" means a yeast expression vector which contains two copies of the insecticidal peptide expression cassette.

"ELISA" or "iELISA" means a molecular biology protocol in which the samples are fixed to the surface of a plate and then detected as follows: a primary antibody is applied followed by a secondary antibody conjugated to an enzyme which converts a colorless substrate to colored substrate which can be detected and quantified across samples. During the protocol, antibodies are washed away such that only those that bind to their epitopes remain for detection. The samples, in our hands, are proteins isolated from plants, and ELISA allows for the quantification of the amount of expressed transgenic protein recovered.

"Expression ORF" means a nucleotide encoding a protein complex and is defined as the nucleotides in the ORF.

"ER" or "Endoplasmic reticulum" is a subcellular organelle common to all eukaryotes where some post translation modification processes occur.

"ERSP" or "Endoplasmic reticulum signal peptide" is an N-terminus sequence of amino acids that during protein translation of the mRNA molecule encoding an insecticidal and/or nematicidal protein is recognized and bound by a host cell signal-recognition particle, which moves the protein translation ribosome/mRNA complex to the ER in the cytoplasm. The result is the protein translation is paused until it docks with the ER where it continues and the resulting protein is injected into the ER.

"ersp" means a nucleotide encoding the peptide, ERSP.

"ER trafficking" means transportation of a cell expressed protein into ER for post-translational modification, sorting and transportation.

"FECT" means a transient plant expression system using Foxtail mosaic virus with elimination of coating protein gene and triple gene block.

"GFP" means a green fluorescent protein from the jellyfish *Aequorea victoria*. It is an example of a translational stabilizing protein.

"High Production peptide" or "HP peptide" means a peptide which is capable of being made, or is "converted," according to the procedures described herein and which, once converted can be produced at increased yields, or higher rates of production, or in greater than normal amounts, in a biological system. The higher rates of production can be from 20 to 400% or greater than can be achieved with a peptide before conversion, using the same or similar production methods that were used to produce the peptide before conversion.

"Homology" when used in relation to nucleic acids refers to a degree of complementarity. There may be partial homology or complete homology (i.e., identity). "Sequence identity" refers to a measure of relatedness between two or more nucleic acids or proteins, and is given as a percentage with reference to the total comparison length. The identity calculation takes into account those nucleotide or amino acid residues that are identical and in the same relative positions in their respective larger sequences. Calculations of identity may be performed by algorithms contained within computer programs such as "GAP" (Genetics Computer Group, Madison, Wis.) and "ALIGN" (DNAStar, Madison, Wis.). A partially complementary sequence is one that at least partially inhibits (or competes with) a completely complementary sequence from hybridizing to a target nucleic acid is referred to using the functional term "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (i.e., the hybridization) of a sequence which is completely homologous to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target which lacks even a partial degree of complementarity (e.g., less than about 30% identity); in the absence of non-specific binding the probe will not hybridize to the second non-complementary target.

In preferred embodiments, hybridization conditions are based on the melting temperature (Tm) of the nucleic acid binding complex and confer a defined "stringency" The term "hybridization" refers to the pairing of complementary nucleic acids. Hybridization and the strength of hybridization (i.e., the strength of the association between the nucleic acids) is impacted by such factors as the degree of complementary between the nucleic acids, stringency of the conditions involved, the Tm of the formed hybrid, and the G:C ratio within the nucleic acids. A single molecule that contains pairing of complementary nucleic acids within its structure is said to be "self-hybridized."

The term "Tm" refers to the "melting temperature" of a nucleic acid. The melting temperature is the temperature at which a population of double-stranded nucleic acid molecules becomes half dissociated into single strands. The equation for calculating the Tm of nucleic acids is well known in the art. As indicated by standard references, a simple estimate of the Tm value may be calculated by the equation: $Tm=81.5+0.41(\% G+C)$, when a nucleic acid is in aqueous solution at 1 M NaCl. The term "stringency" refers to the conditions of temperature, ionic strength, and the presence of other compounds such as organic solvents, under which nucleic acid hybridizations are conducted. With "high stringency" conditions, nucleic acid base pairing will occur only between nucleic acid fragments that have a high frequency of complementary base sequences. Thus, conditions of "low" stringency are often required with nucleic acids that are derived from organisms that are genetically diverse, as the frequency of complementary sequences is usually less.

"Low stringency conditions" when used in reference to nucleic acid hybridization comprise conditions equivalent to binding or hybridization at 42 C° in a solution consisting of 5×SSPE (43.8 g/l NaCl, 6.9 g/l NaH2PO4.H2O and 1.85 g/l EDTA, pH adjusted to 7.4 with NaOH), 0.1% SDS, 5×Denhardt's reagent [50×Denhardt's contains per 500 ml: 5 g Ficoll (Type 400, Pharmacia), 5 g BSA (Fraction V; Sigma)] and 100 μg/mL denatured salmon sperm DNA followed by washing in a solution comprising 5×SSPE, 0.1% SDS at 42 C° when a probe of about 500 nucleotides in length is employed.

"Medium stringency conditions" when used in reference to nucleic acid hybridization comprise conditions equivalent to binding or hybridization at 42 C° in a solution consisting of 5×SSPE (43.8 g/l NaCl, 6.9 g/l NaH2PO4.H2O and 1.85 g/l EDTA, pH adjusted to 7.4 with NaOH), 0.5% SDS, 5×Denhardt's reagent and 100 μg/mL denatured salmon sperm DNA followed by washing in a solution comprising 10×SSPE, 1.0% SDS at 42 C° when a probe of about 500 nucleotides in length is employed.

"High stringency conditions" when used in reference to nucleic acid hybridization comprise conditions equivalent to binding or hybridization at 42 C° in a solution consisting of 5.times.SSPE (43.8 g/l NaCl, 6.9 g/l NaH2PO4.H2O and 1.85 g/l EDTA, pH adjusted to 7.4 with NaOH), 0.5% SDS, 5×Denhardt's reagent and 100 μg/mL denatured salmon sperm DNA followed by washing in a solution comprising 0.1×SSPE, 1.0% SDS at 42 C° when a probe of about 500 nucleotides in length is employed.

It is well known that numerous equivalent conditions may be employed to comprise low stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol) are considered and the hybridization solution may be varied to generate conditions of low stringency hybridization different from, but equivalent to, the above listed conditions. In addition, the art knows conditions that promote hybridization under conditions of high stringency (e.g., increasing the temperature of the hybridization and/or wash steps, the use of formamide in the hybridization solution, etc.).

"Hybrid peptide," aka "Hybrid", aka "hybrid toxin," aka "hybrid-ACTX-Hv1a," aka "native hybridACTX-Hv1a," as well as "U peptide," aka "U toxin," aka "native U," aka "U-ACTX-Hv1a," aka "native U-ACTX-Hv1a," all refer to an ACTX peptide, which was discovered from a spider known as the Australian Blue Mountains Funnel-web Spider, *Hydronyche versuta*, and is a dual antagonist to insect voltage-gated Ca2+ channels and voltage-gated K+ channels.

"IGER" means a name for a short peptide, based on its actual sequence of one letter codes. It is an example of a peptide that is only cleaved in insects.

"ICK motif," "ICK motif protein," "ICK polypeptides", "ICK proteins", "inhibitor cystine knot motif," "Toxic insect ICK TPs," "ICK motif TPs," "CK" peptides," "cystine knot motif," or "cystine knot peptides" (all used interchangeably herein), means a 16 to 60 amino acid peptide with at least 6 half-cystine core amino acids having three disulfide bridges, wherein the 3 disulfide bridges are covalent bonds and of the six half-cystine residues the covalent disulfide bonds are between the first and fourth, the second and fifth, and the third and sixth half-cystines, of the six core half-cystine amino acids starting from the N-terminal amino acid. In general this type of peptide comprises a beta-hairpin secondary structure, normally composed of residues situated between the fourth and sixth core half-cystines of the motif, the hairpin being stabilized by the structural crosslinking provided by the motif's three disulfide bonds. Note that additional cysteine/cystine or half-cystine amino acids may be present within the inhibitor cystine knot motif. Examples are provided in the sequence listing. Representative example of ICK proteins include U-ACTX insecticidal peptides, Omega-ACTX insecticidal peptides and Kappa-ACTX insecticidal peptides.

"ick" means a nucleotide encoding an ICK motif protein.

"ICK motif protein expression ORF" or "expression ORF" means a nucleotide encoding an ICK motif protein complex and is defined as the nucleotides in the ORF.

"ICK motif protein expression vector" or "ICK expression vector", or "ICK motif expression vector," means a binary vector which contains an expression ORF. The binary vector also contains the necessary transcription promoter and terminator sequence surrounding the expression ORF to promote expression of the ORF and the protein it encodes.

"Insect" includes all organisms in the class "Insecta". The term "pre-adult" insects refers to any form of an organism prior to the adult stage, including, for example, eggs, larvae, and nymphs.

"Insect gut environment" or "gut environment" means the specific pH and protease conditions found within the fore, mid or hind gut of an insect or insect larva.

"Insect hemolymph environment" means the specific pH and protease conditions of found within an insect or insect larva.

As used herein, the term "insecticidal" is generally used to refer to the ability of a polypeptide or protein used herein, to increase mortality or inhibit growth rate of insects. As used herein, the term "nematicidal" refers to the ability of a polypeptide or protein used herein, to increase mortality or inhibit the growth rate of nematodes. In general, the term "nematode" comprises eggs, larvae, juvenile and mature forms of said organism.

"Insecticidal activity" means that on or after exposure of the insect to compounds or peptides, the insect either dies stops or slows its movement or its feeding, stops or slows its growth, fails to pupate, cannot reproduce or cannot produce fertile offspring.

"Insecticidal peptide" or "Insecticidal protein" or "toxic polypeptide" or "toxic protein" (used interchangeably herein) means a protein or polypeptide having insecticidal activity when ingested by, in contact with, or injected into an insect.

"Insecticidal peptide production strain screen" means a screening process that identifies the higher-yielding insecticidal peptide production yeast strains from the lower yielding strains. In the described methods herein, it refers to screens that use reverse-phase HPLC or the housefly injection bioassay.

"Integrative expression vector" or "integrative vector" means a yeast expression vector which can insert itself into a specific locus of the yeast cell genome and stably becomes a part of the yeast genome.

"Known peptide" means a peptide known to have biological activity and may be a mature peptide or any version or fragment thereof including pre and pro peptides and conjugates of active peptides. A preferred known peptide is one with insecticidal activity.

"L" in the proper context means a cleavable intervening binary or tertiary peptide. When referring to amino acids, "L" can also mean leucine.

"Linker, Cleavable Linker, or Peptide Linker" means a short peptide sequence (a binary or tertiary peptide) that is the target site of at least two types of proteases one of which is an insect and/or nematode protease and the other one of which is a human protease such that the linker can be separated by both types of protease that can cleave and separate the protein into two parts or a short DNA sequence that is placed in the reading frame in the ORF and encoding a short peptide sequence in the protein that is the target site of an insenctand/or nematode and an animal (e.g. human) protease that can cleave and separate the protein into two parts.

"Lepidopteran gut environment" means the specific pH and protease conditions of found within the fore, mid or hind gut of a lepidopteran insect or larva.

"Lepidopteran hemolymph environment" means the specific pH and protease conditions of found within lepidopteran insect or larva.

"Multiple ICK motif protein domain" means a protein composed of multiple ICK motif TPs which are linked by multiple intervening linker peptides. The ICK motif TPs in the multiple ICK motif TP domain can be same or different, and the intervening linker peptides in this domain can also be the same or different.

"Nematicidal peptide" or "nematicidal protein" means a peptide or protein having nematicidal activity when ingested by, in contact with, or injected into a nematode and is used as an example of a toxic peptide and toxic protein.

"Nematicides" and "nematicidal" refers to the ability of a nematicidal peptide or nematicidal protein to increase mortality or inhibit the growth rate of nematodes. In general, the term "nematode" comprises eggs, larvae, juvenile and mature forms of said organism.

"Non-ICK CRIPS" can have 4-8 cysteines which form 2-4 disulfide bonds. Non-ICK TPs include cystine knot peptides that are not ICK TPs. Non-ICK TPs may have different connection orders of the cystine bonds than ICKs. Examples of a Non-ICK CRIP are peptides like Av2 and Av3 which are peptides first identified from sea anemones. These anemone peptides are examples of a class of compounds that modulate sodium channels in the insect peripheral nervous system (PNS).

"Non-Polar amino acid" is an amino acid that is weakly hydrophobic and includes glycine, alanine, proline, valine, leucine, isoleucine, phenylalanine and methionine. Glycine or gly is the most preferred non-polar amino acid for the dipeptides of this invention.

"Normalized peptide yield" means the peptide yield in the conditioned medium divided by the corresponding cell density at the point the peptide yield is measured. The peptide yield can be represented by the mass of the produced peptide in a unit of volume, for example, mg per liter or mg/L, or by the UV absorbance peak area of the produced peptide in the HPLC chromatograph, for example, mAu·sec. The cell density can be represented by visible light absorbance of the culture at wavelength of 600 nm (OD600).

"One letter code" means the peptide sequence which is listed in its one letter code to distinguish the various amino acids in the primary structure of a protein. alanine=A, arginine=R, asparagine=N, aspartic acid=D, asparagine or aspartic acid=B, cysteine=C, glutamic acid=E, glutamine=Q, glutamine or glutamic acid=Z, glycine=G, histidine=H, isoleucine=I, leucine=L, lysine=K, methionine=M, phenylalanine=F, proline=P, serine=S, threonine=T, tryptophan=W, tyrosine=Y, valine=V.

"Omega peptide" also referred to herein as "omega toxin," which includes the example, "omega-ACTX-Hv1a," aka "native omegaACTX-Hv1a," all refer to a class of ACTX peptides which were first isolated from a spider known as the Australian Blue Mountains Funnel-web Spider, *Hydronyche versuta*, and which is an antagonist to the insect voltage-gated Ca2+ channel.

"ORF" or "Open reading frame" or "peptide expression ORF" means that DNA sequence encoding a protein which begins with an ATG start codon and ends with a TGA, TAA or TAG stop codon. ORF can also mean the translated protein that the DNA encodes.

"Operably linked" means that the two adjacent DNA sequences are placed together such that the transcriptional activation of one can act on the other.

"PEP" means Plant Expressed Peptide.

"Peptide expression cassette", or "expression cassette" means a DNA sequence which is composed of all the DNA elements necessary to complete transcription of an insecticidal peptide in a biological expression system. In the described methods herein, it includes a transcription promoter, a DNA sequence to encode an α-mating factor signal sequence and a Kex 2 cleavage site, an insecticidal peptide transgene, a stop codon and a transcription terminator.

"Peptide expression vector" means a host organism expression vector which contains a heterologous insecticidal peptide transgene.

"Peptide expression yeast strain", "peptide expression strain" or "peptide production strain" means a yeast strain which can produce a heterologous insecticidal peptide.

"Peptide made special" means a peptide previously having low peptide yield from a biological expression system that becomes an HP peptide because of the methods described herein used to increase its yield.

"Peptide Linker" see Linker.

"Peptide transgene" or "insecticidal peptide transgene" means a DNA sequence that encodes an insecticidal peptide and can be translated in a biological expression system.

"Peptide yield" means the insecticidal peptide concentration in the conditioned medium which is produced from the cells of a peptide expression yeast strain. It can be represented by the mass of the produced peptide in a unit of volume, for example, mg per liter or mg/L, or by the UV absorbance peak area of the produced peptide in the HPLC chromatograph, for example, mAu·sec.

"Peritrophic membrane" means a lining inside the insect gut that traps large food particles can aid in their movement through the gut while allowing digestion, but also protecting the gut wall.

"Pest" includes, but is not limited to: insects, fungi, bacteria, nematodes, mites, ticks, and the like.

"PFIP" means a protein that can form a pore or channel in the cells that line an insect gut, such as gut epithelium cells. Examples of PFIPS are Bt toxic peptides (Bt TPs) such as cry, crt and VIP other PFIP examples can be found in the sequence listing.

"Plant regeneration media" means any media that contains the necessary elements and vitamins for plant growth and plant hormones necessary to promote regeneration of a cell into an embryo which can germinate and generate a plantlet derived from tissue culture. Often the media contains a selectable agent to which the transgenic cells express a selection gene that confers resistance to the agent.

"Plant transgenic protein" means a protein from a heterologous species that is expressed in a plant after the DNA or RNA encoding it was delivered into one or more of the plant cells.

"Polar amino acid" is an amino acid that is polar and includes serine, threonine, cystine, cysteine, asparagine, glutamine, histidine, tryptophan and tyrosine; preferred polar amino acids are serine, threonine, cystine, cysteine, asparagine and glutamine; with serine being most highly preferred.

"Post-transcriptional gene silencing", or "PTGS", means a cellular process within living cells that suppress the expression of a gene.

"Protein" has the same meaning as "Peptide" in this document.

"Recombinant vector" means a DNA plasmid vector into which foreign DNA has been inserted.

"Selection gene" means a gene which confers an advantage for a genomically modified organism to grow under the selective pressure.

"Spacer" or "spacers" means a peptide comprising 1 to 4 amino acids that is fused in frame to either the N-terminus of a binary peptide, or to the C-terminus of the binary peptide, or both to the N-terminus and the C-terminus of a binary peptide as is disclosed herein, thus forming a tertiary peptide. Tertiary peptides differ from binary peptides in that they are like a binary peptide only with an additional region called a spacer comprising any 1 to 4 amino acids, more often 2 to 4 amino acids, sometimes 1, sometimes 2, sometimes 3 and sometimes 4 amino acids and is also sometimes called the "Z" region. In some specific embodiments, the spacer may be referred to as "+2" or "plus-2" which is in reference to the portion of the peptide that is a dipeptide comprising any two amino acid peptides as described herein, such as for example "GS." In some embodiments, the so called tertiary peptides of the present invention have three regions, they are: the X and Y region and the third region is called either a "spacer" or "Z" region. In some embodiments, each of X and Y can be 2-4 amino acids in length, and Z can be an additional 1-4 amino acids in length per Z with 1 or 2 Z regions possible if one Z is before and one Z is after the binary peptide, thus allowing for a 16 amino acid linker.

"STA", or "Translational stabilizing protein", or "stabilizing domain", or "stabilizing protein", (used interchangeably herein) means a protein with sufficient tertiary structure that it can accumulate in a cell without being targeted by the cellular process of protein degradation. The protein can be between 5 and 50 amino acids (aa). In some embodiments used throughout the exemplary embodiments herein, a STA may include an ICK-motif protein), 50 to 250 aa (GNA), 250 to 750 aa (e.g., chitinase) and 750 to 1500 aa (e.g., enhancin). The translational stabilizing protein is coded by a DNA sequence for a protein that is fused in frame with a sequence encoding an insecticidal protein in the ORF. The fusion protein can either be upstream or downstream of the toxic protein and can have any intervening sequence between the two sequences as long as the intervening sequence does not result in a frame shift of either DNA sequence. The translational stabilizing protein can also have an activity which increases delivery of the ICK motif TP across the gut wall and into the hemolymph of the insect. Such a delivery can be achieved by actively trafficking the entire ORF across the gut wall, or by cleavage within the gut environment to separate the ICK motif TP while the translational stabilizing protein damages the peritrophic membrane and/or gut wall to increase diffusion of the ICK motif TP into the hemolymph.

"sta" means a nucleotide encoding a translational stabilizing protein.

"TMOF" "TMOF motif," or "TMOF TPs" means "trypsin modulating oostatic factor" protein sequences. Examples are provided in the sequence listing. Numerous examples and variants are provided herein. SEQ ID NO: 708 is the wild type TMOF sequence. Other non-limiting variants are provided in SEQ ID NOs: 709-721. Other examples would be known or could be created by one skilled in the art.

"Toxic peptide" or "toxic protein" or "TP" (all used interchangeably) means a peptide or protein having insecticidal and/or nematicidal activity when ingested by, in contact with, or injected into an insect or nematode respectively. TPs of the present invention also include modified TPs, mutant TPs or derivative TPs. In some embodiments, a mutant or variant TP encompasses a TP that may have one or more conservative amino acid substitutions, that when combined, the conservative amino acid substitutions do not substantially diminish the insecticidal and/or nematicidal activity of the mutated TP in relation to its non-mutated TP, i.e. retains the insecticidal and/or nematicidal activity of at least 90%, or at least 80%, or at least 70%, or at least 60%, or at least 50%, or at least 40%, or at least 30% of the insecticidal and/or nematicidal activity of the non-mutated TP. TPs may also include peptides and proteins encoded by a polynucleotide having one or more point mutations, for example, 1, 2, 3, 4, 5, 6, 7, 8, 9, or 10 point mutations or more, such that when the mutated TP encoding polynucleotide is transcribed and/or translated, the expressed mutated TP peptide or protein retains insecticidal and/or nematicidal activity that is at least 90%, or at least 80%, or at least 70%, or at least 60%, or at least 50%, or at least 40%, or at least 30% of the insecticidal and/or nematicidal activity of the peptide or protein encoded by the corresponding non-mutated TP polynucleotide. TPs of the present invention may also include TP peptides and proteins that have at least 80%, or at least 85%, or at least 90%, or at least 95%, or at least 96% or at least 97% or at least 98% or at least 99% amino acid sequence identity to any TP disclosed in SEQ ID NO: 5-1593 and 1761-1775 and 1761-1775, and still retains at least at least 90%, or at least 80%, or at least 70%, or at least 60%, or at least 50%, or at least 40%, or at least 30% of the insecticidal and/or nematicidal activity of the corresponding TP set forth in SEQ ID NO: 5-1593 and 1761-1775. TPs of the present invention may also include TP peptides and proteins having 1-6 amino acid extensions fused in frame to the N-terminus or C-terminus or both termini of any TP having an amino acid sequence as set forth in SEQ ID NOs: 5-1593 and 1761-1775.

"TSP" or "total soluble protein" means the total amount of protein that can be extracted from a plant tissue sample and solubilized into the extraction buffer.

"Transgene" means a heterologous DNA sequence encoding a protein which is transformed into a plant.

"Transgenic host cell" means a cell which is transformed with a gene and has been selected for its transgenic status via an additional selection gene.

"Transgenic plant" means a plant that has been derived from a single cell that was transformed with foreign DNA such that every cell in the plant contains that transgene.

"Transient expression system" means an *Agrobacterium tumefaciens*-based system which delivers DNA encoding a disarmed plant virus into a plant cell where it is expressed. The plant virus has been engineered to express a protein of interest at high concentrations, up to 40% of the TSP. In the technical proof, there are two transient expression systems used, a TRBO and a FECT system and the plant cells are leaf tissue of a tobacco plant "*Nicotiana benthamiana.*"

"TRBO" means a transient plant expression system using Tobacco mosaic virus with removal of the viral coating protein gene.

"Trypsin cleavage" means an in vitro assay that uses the protease enzyme trypsin (which recognizes exposed lysine and arginine amino acid residues) to separate a cleavable linker at that cleavage site. It also means the act of the trypsin enzyme cleaving that site.

"U-ACTX peptide," or a "U protein" or a "U toxin," which may include examples of "native U," or "U-ACTX-Hv1a," or "native U-ACTX-Hv1a," which includes the representative example, "Hybrid peptide," aka "hybrid toxin," aka "hybrid-ACTX-Hv1a," aka "native hybridACTX-Hv1a," all refer to a native protein or native toxin, that can be found in nature or is otherwise known as examples of U-ACTX peptides, which in the case of "U-ACTX-Hv1a," aka "native U-ACTX-Hv1a," is a native spider toxin, that was first discovered from a spider with origins in the Australian Blue Mountains and is dual antagonist against insect voltage gated Ca2+ channels and K+ channels. The spider from which the toxin was discovered is known as the Australian Blue Mountains Funnel-web Spider, which has the scientific name *Hydronyche versuta.*

"U+2 peptide," "U+2 protein", "U+2 toxin," or "U+2," or "U+2-ACTX-Hv1a," all refer to either a toxin, which has an additional dipeptide operatively linked to the native peptide, and may refer to the spider toxin which is sometimes called the U peptide and other names noted above. The additional dipeptide that is operatively linked to the U peptide and thus indicated as "+2" or "plus 2" can be selected among several peptides, any of which may result in a "U+2 peptide" with unique properties as discussed herein. These are also sometimes called "high production peptides." When the term "U+2-ACTX-Hv1a" is used, it refers to a specific high production toxic peptide, comprising a naturally occurring peptide from the Australian Blue Mountains Funnel-web Spider, which has the scientific name *Hydronyche versuta.*

"VIP" proteins were discovered from screening the supernatant of vegetatively grown strains of Bt for possible insecticidal activity. They have little or no similarity to cry proteins and they were named Vegetative Insecticidal Proteins or VIP. Of particular use and preference for use with this document are what have been called VIP3, Vip3 proteins or Vip toxins which have Lepidopteran activity. They are thought to have a similar mode of action as Bt cry peptides. In this document VIP proteins are categorized as a PFIP type of protein.

"Yeast expression vector," or "expression vector", or "vector," means a plasmid which can introduce a heterologous gene and/or expression cassette into yeast cells to be transcribed and translated.

"Yield" refers to the production of a peptide, and increased yields can mean increased amounts of production, increased rates of production, and an increased average or median yield and increased frequency at higher yields.

(1). Cleavable Linking Groups for Insecticidal and/or Nematicidal Proteins

Figure 2:
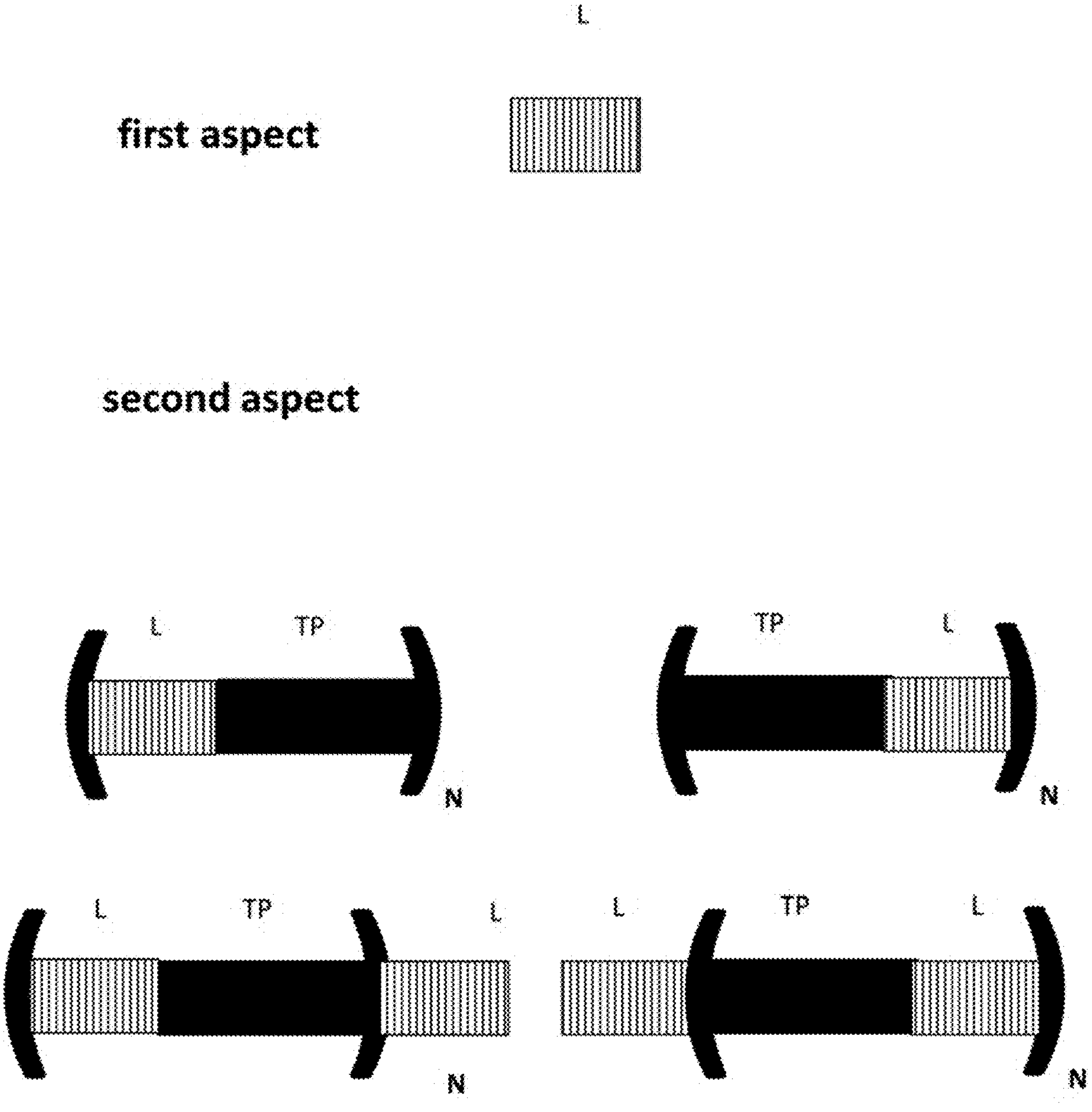
FIG. 2. Demonstration of first and second aspects that are exemplary embodiments of the invention. The first aspect is the graphical representation of a binary and/or tertiary cleavable linker peptide designated (L). The second aspect illustrates various combinations of L fused to a toxic peptide or protein (TP) (from 1-200 repeats).

The present invention provides binary and tertiary peptides that are operable to be cleaved in the insect, or nematode gut or hemolymph environment and in an animal gastrointestinal system, for example, a human, gastrointestinal system. The present invention therefore provides cleavable binary and tertiary peptides that when linked to other components of a larger insecticidal or nematicidal protein, may be cleaved by certain proteases and peptidases found in the human, insect and nematode gut environments. Advantageously, multiple copies of insecticidal and nematicidal peptides can be joined or linked, each copy being separated by one or more binary or tertiary peptides, that upon ingestion or contact with the insect and/or nematode peptidase or protease in the gut environment, the binary or tertiary peptides are cleaved releasing the active forms of the linked insecticidal and nematicidal peptides (See for example FIG. 2, second aspect) In these illustrative embodiments, N as shown in FIG. 2 second aspect, can be any integer ranging from 1 to 200, or for example, 1 to 100, or preferably from 1 to 10 and any integer therebetween. In various embodiments of the present invention, the binary and/or tertiary peptides may be linked to 1 or as many as 200 toxic peptides (i.e. insecticidal and/or nematicidal peptides), and any number there between, for example, 1 to 100, or more preferably 1 to 10, thus forming an insecticidal and/or nematicidal transgenic protein, that upon exposure to the insect, nematode or human gastric gut environment will cleave at specific substrate sequences in the binary and/or tertiary peptides, thereby liberating a plurality of toxic peptides from a polymer insecticidal and/or nematicidal protein structure. In various embodiments, polynucleotides encoding insecticidal and/or nematicidal transgenic proteins can be used to transform plant cells. In some embodiments, the insecticidal and/or nematicidal transgenic proteins may be formulated into compositions that can be sprayed or otherwise applied in any manner known to those skilled in the art to the surface of plants or parts thereof. Accordingly, DNA constructs are provided herein, operable to encode one or more insecticidal and/or nematicidal transgenic proteins under the appropriate conditions in a host cell, for example, a plant cell. Methods for controlling a pest infection by a parasitic insect, or a parasitic nematode of a plant cell comprises administering or introducing a polynucleotide encoding an insecticidal and/or nematicidal transgenic protein as described herein to a plant, plant tissue, or a plant cell by recombinant techniques and growing said recombinantly altered plant, plant tissue or plant cell in a field exposed to the pest. Alternatively, the insecticidal and/or nematicidal transgenic protein can be formulated into a sprayable composition and applied directly to susceptible plants by direct application, such that upon ingestion of the insecticidal and/or nematicidal transgenic protein by the infectious insect and/or nematode, one or more copies or monomers of the insecticidal and nematicidal peptide is cleaved from the insecticidal and/or nematicidal protein ingested by the infectious insect and/or nematode and produces its effect to destroy the insect and/or nematode.

(1A). Cleavable Binary and Tertiary Linking Peptides

In various embodiments, the present invention provides cleavable binary and tertiary linking peptides that are cleaved in the presence of an animal, insect and nematode protease or peptidase found in the gastrointestinal system of an animal, for example, a human, an insect and/or a nematode. As used herein, the terms gastrointestinal and gut environment are used interchangeably, and is meant to include its common meaning, i.e. the location where ingested food items are proteolytically degraded. In the human model, the gastrointestinal environment that is capable of breaking down peptides and proteins can include the mouth, stomach and small intestine.

Some of the available proteases and peptidases found in insect and nematode gut environment are dependent on the life-stage of the insect as these enzymes are often spatially and temporally expressed. The digestive system of the insect is composed of the alimentary canal and associated glands. Food enters the mouth and is mixed with secretions that may or may not contain digestive proteases and peptidases. The foregut and the hind gut are ectodermal in origin. The foregut serves generally as a storage depot for raw food. From the foregut discrete packages of food pass into the midgut (mesenteron or ventriculus). The midgut is the site of digestion and absorption of food nutrients. Generally, the presence of certain proteases and peptidases in the midgut follow the pH of the gut. Certain proteases and peptidases in the human gastrointestinal system may include: pepsin, trypsin, chymotrypsin, elastase, carboxypeptidase, aminopeptidase, and dipeptidase. Insect and nematode gut environment, include the regions of the digestive system in the herbivore species where peptides and proteins are degraded during digestion. Some of the available proteases and peptidases found in insect and nematode gut environments may include: (1) serine proteases; (2) cysteine proteases; (3) aspartic proteases, and (4) metalloproteases.

The two predominant protease classes in the digestive systems of phytophagous insects are the serine and cysteine proteases. Murdock et al. (1987) carried out an elaborate study of the midgut enzymes of various pests belonging to Coleoptera, while Srinivasan et al. (2008) have reported on the midgut enzymes of various pests belonging to Lepidoptera. Serine proteases are known to dominate the larval gut environment and contribute to about 95% of the total digestive activity in Lepidoptera, whereas the Coleopteran species have a wider range of dominant gut proteases, including cysteine proteases. The papain family contains peptidases with a wide variety of activities, including endopeptidases with broad specificity (such as papain), endopeptidases with very narrow specificity (such as glycyl endopeptidases), aminopeptidases, dipeptidyl-peptidase, and peptidases with both endopeptidase and exopeptidase activities (such as cathepsins B and H). Other exemplary proteinases found in the midgut of various insects include trypsin-like enzymes, e.g. trypsin and chymotrypsin, pepsin, carboxypeptidase-B and aminotripeptidases.

Serine proteases are widely distributed in nearly all animals and microorganisms (Joanitti et al., 2006). In higher organisms, nearly 2% of genes code for these enzymes (Barrette-Ng et al., 2003). Being essentially indispensable to the maintenance and survival of their host organism, serine proteases play key roles in many biological processes. Serine proteases are classically categorized by their substrate specificity, notably by whether the residue at P1: trypsin-like (Lys/Arg preferred at P1), chymotrypsin-like (large hydrophobic residues such as Phe/Tyr/Leu at P1), or elastase-like (small hydrophobic residues such as Ala/Val at P1) (revised by Tyndall et. al., 2005). Serine proteases are a class of proteolytic enzymes whose central catalytic machinery is composed of three invariant residues, an aspartic acid, a histidine and a uniquely reactive serine, the latter giving rise to their name, the "catalytic triad". The Asp-His-Ser triad can be found in at least four different structural contexts (Hedstrom, 2002). These four clans of serine proteases are typified by chymotrypsin, subtilisin, carboxypeptidase Y, and Clp protease. The three serine proteases of the chymotrypsin-like clan that have been studied in greatest detail are chymotrypsin, trypsin, and elastase. More recently, serine proteases with novel catalytic triads and dyads have been discovered for their roles in digestion, including Ser-His-Glu, Ser-Lys/His, His-Ser-His, and N-terminal Ser.

All major types of peptidases have been described in nematodes. Aspartic peptidases have been described primarily in functions related to the digestion of nutrients. In invertebrates it is thought that, along with the cysteine peptidases, these have the same role as aspartic and serine peptidases in vertebrates. In parasitic nematodes, the cysteine peptidases cover virtually all functions in which peptidases are involved in parasitic nematodes. Accordingly, Cathepsins B and L are types of cysteine peptidases belonging to the papain family, and have been comprehensively studied in nematodes. High variability has been found among the cathepsins B from different species of nematodes regarding optimum temperature and pH, and substrate affinity. It is thought that their main role is to digest nutrients and that the high interspecific variability observed is due to the nematode adapting to the ecological niche it occupies. Cathepsins L also seem to be involved in the digestion of nutrients.

One class of well-studied digestive enzymes found in the gut environment of insects and nematodes is the class of cysteine proteases. The term "cysteine protease" is intended to describe a protease that possesses a highly reactive thiol group of a cysteine residue at the catalytic site of the enzyme. There is evidence that many phytophagous insects and plant parasitic nematodes rely, at least in part, on midgut cysteine proteases for protein digestion. These include but are not limited to Hemiptera, especially squash bugs (*Anasa tristis*); green stink bug (*Acrosternum hilare*); Riptortus *clavatus*; and almost all Coleoptera examined to date, especially, Colorado potato beetle (*Leptinotarsa deaemlineata*); three-lined potato beetle (*Lema trilineata*); asparagus beetle (*Crioceris asparagi*); Mexican bean beetle (*Epilachna varivestis*); red flour beetle (*Triolium castaneum*); confused flour beetle (*Tribolium confusum*); the flea beetles (*Chaetocnema* spp., *Haltica* spp., and *Epitrix* spp.); corn rootworm (*Diabrotica* Spp.); cowpea weevil (*Callosobruchus aculatue*); boll weevil (*Antonomus grandis*); rice weevil (*Sitophilus oryza*); maize weevil (*Sitophilus* zeamais); granary weevil (*Sitophilus granarius*); Egyptian alfalfa weevil (*Hypera postica*); bean weevil (*Acanthoseelides obtectus*); lesser grain borer (*Rhyzopertha dominica*); yellow meal worm (*Tenebrio molitor*); Thysanoptera, especially, western flower *thrips* (*Franklini ella occidentalis*); Diptera, especially, leafminer spp. (*Liriomyza trifolii*); plant parasitic nematodes especially the potato cyst nematodes (*Globodera* spp.), the beet cyst nematode (*Heterodera schachtii*) and root knot nematodes (*Meloidogyne* spp.).

Another class of digestive enzymes is the aspartic proteases. The term "aspartic protease" is intended to describe a protease that possesses two highly reactive aspartic acid residues at the catalytic site of the enzyme and which is most often characterized by its specific inhibition with pepstatin, a low molecular weight inhibitor of nearly all known aspartic proteases. There is evidence that many phytophagous insects rely, in part, on midgut aspartic proteases for protein digestion most often in conjunction with cysteine proteases. These include but are not limited to Hemiptera especially (*Rhodnius prolixus*) and bedbug (*Cimex* spp.) and members of the families Phymatidae, Pentatomidae, Lygaeidae and Belostomatidae; Coleoptera, in the families of the Meloidae, Chrysomelidae, Coccinelidae and Bruchidae all belonging to the series Cucujifornia, especially, Colorado potato beetle (*Leptinotarsa decemlineata*) three-lined potato beetle (*Lematri lineata*); southern and western corn rootworm (*Diabrotica undecimpunctata* and *D. virgifera*), boll weevil (*Anthonomus grandis*), squash bug (Anasatristis); flea beetle (*Phyllotreta crucifera*), bruchid beetle (*Callosobruchus maculatus*), mexican bean beetle (*Epilachna varivestis*), soybean leafminer (Odontota *horni*), margined blister beetle (*Epicauta pestifera*) and the red flour beetle (*Triolium castaneum*); Diptera, especially housefly (*Musca domestica*) (Terra and Ferreira (1994) Comn. Biochem. Physiol. 109B: 1-62; Wolfson and Murdock (1990) J. Chem. Ecol. 16: 1089-1102).

In various embodiments, the present invention provides binary and tertiary peptides that act as substrates for human, insect and nematode proteinases, proteases and peptidases (collectively referred to herein as "proteases") as described above. In various embodiments, binary peptides and tertiary peptides contain at least 4 amino acids and up to a maximum of 16 amino acids comprised of 2 or 3 different regions. Accordingly, binary peptides have two different regions and tertiary peptides have three different regions. In various embodiments, the binary peptides and the tertiary peptides of the present invention are all cleavable by a human protease within one region and an insect and/or nematode protease in the second region. Tertiary peptides differ from binary peptides in that they have an additional region called a spacer comprising 1 to 4 amino acids. In some embodiments, the spacer can be a "+2" or "plus-2" dipeptide comprising any two amino acids as described herein.

As used herein, simply for describing the different permutations and combinations of amino acids that can form the binary and tertiary peptides, for illustrative purposes only, the first region of the binary and tertiary peptide is named "X" and "X" is a substrate for an insect and/or a nematode protease, and the second region of the binary and tertiary peptide is called "Y", which is a substrate for an animal for example, a human protease, for example, a human protease found in the human gastrointestinal system. In some embodiments, the tertiary peptides of the present invention have an X and Y region and the third region is called a spacer or "Z" region. In some embodiments, each of X and Y can be 2-4 amino acids in length, and Z can be 1-4 amino acids in length. In some embodiments, the binary and/or tertiary cleavable peptides cannot be cleaved by a plant protease, especially when the insecticidal and/or nematicidal protein is expressed in a plant, or part thereof. In these embodiments, the insecticidal and/or nematicidal protein expressed by the plant cannot be cleaved by a plant protease in situ, but can be cleaved by a human or insect or nematode gut protease when the plant or part thereof expressing the insecticidal and/or nematicidal protein is ingested by the human or insect or nematode.

(1B). Descriptions and Examples of Binary Peptides

Accordingly, the binary peptide can comprise or consist of $X_{(2-4)}Y_{(2-4)}$, or $Y_{(2-4)}X_{(2-4)}$, and an exemplary tertiary peptide can comprise $X_{(2-4)}Y_{(2-4)}Z_{(1-4)}$, or $Z_{(1-4)}X_{(2-4)}Y_{(2-4)}$, or $Y_{(2-4)}X_{(2-4)}Z_{(1-4)}$, or $Z_{(1-4)}Y_{(2-4)}X_{(2-4)}$, or $Z_{(1-4)}X_{(2-4)}Y_{(2-4)}Z_{(1-4)}$, or $Z_{(1-4)}Y_{(2-4)}X_{(2-4)}Z_{(1-4)}$, wherein each number in the parenthesis denotes the number of amino acids for that region. For example $X_{(2-4)}$ denotes an X region with two to four amino acids, for example, $X_1X_2$ (two amino acids) or $X_1X_2X_3$ (three amino acids) or $X_1X_2X_3X_4$ (four amino acids). For example, a binary peptide can include the amino acid sequence: $X_1$-$X_2$-$Y_1$-$Y_2$, $X_1$-$X_2$-$X_3$-$Y_1$-$Y_2$, $X_1$-$X_2$-$X_3$-$X_4$-$Y_1$-$Y_2$, $X_1$-$X_2$-$Y_1$-$Y_2$-$Y_3$, $X_1$-$X_2$-$X_3$-$Y_1$-$Y_2$-$Y_3$, $X_1$-$X_2$-$X_3$-$X_4$-$Y_1$-$Y_2$-$Y_3$, $X_1$-$X_2$-$Y_1$-$Y_2$-$Y_3$-$Y_4$, $X_1$-$X_2$-$X_3$-$Y_1$-$Y_2$-$Y_3$-$Y_4$, $X_1$-$X_2$-$X_3$-$X_4$-$Y_1$-$Y_2$-$Y_3$-$Y_4$, $Y_1$-$Y_2$-$X_1$-$X_2$, $Y_1$-$Y_2$-$X_1$-$X_2$-$X_3$, $Y_1$-$Y_2$-$X_1$-$X_2$-$X_3$-$X_4$, $Y_1$-$Y_2$-$Y_3$-$X_1$-$X_2$, $Y_1$-$Y_2$-$Y_3$-$X_1$-$X_2$-$X_3$, $Y_1$-$Y_2$-$Y_3$-$X_1$-$X_2$-$X_3$-$X_4$, $Y_1$-$Y_2$-$Y_3$-$Y_4$-$X_1$-$X_2$, $Y_1$-$Y_2$-$Y_3$-$Y_4$-$X_1$-$X_2$-$X_3$, $Y_1$-$Y_2$-$Y_3$-$Y_4$-$X_1$-$X_2$-$X_3$-$X_4$, wherein each $X_n$ and each $Y_n$ is an amino acid, and wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

In various embodiments, exemplary X region peptide sequences, i.e., peptide sequences that may be cleaved by one or more insect and/or nematode proteases found in the insect and/or nematode gut/hemolymph environment may include: AAG, AAK, AAR, AFG, AFK, AFR, AGF, AGI, AGK, AGL, AGN, AGQ, AGR, AGS, AGT, AGY, AIG, AIK, AIN, AIQ, AIR, AKF, AKG, AKI, AKK, AKL, AKN, AKQ, AKR, AKS, AKT, AKY, ALG, ALK, ALN, ALQ, ALR, APF, APG, APK, APR, ARF, ARG, ARI, ARK, ARL, ARN, ARQ, ARR, ARS, ART, ARY, ASG, ASK, ASR, ATG, ATK, ATR, AVG, AVK, AVR, AYG, AYK, AYR, DGK, DGR, DIG, DIK, DIR, DLG, DLK, DLR, EGK, EGR, EIG, EIK, EIR, ELG, ELK, ELR, ER, FVR, GAF, GAI, GAK, GAL, GAR, GAY, GFK, GFR, GIK, GIN, GIQ, GIR, GKA, GKD, GKE, GKF, GKI, GKK, GKL, GKN, GKQ, GKR, GKS, GKT, GKV, GKY, GLK, GLN, GLQ, GLR, GNA, GNK, GNR, GNV, GPK, GPR, GQA, GQK, GQR, GQV, GRA, GRD, GRE, GRF, GRI, GRK, GRL, GRN, GRQ, GRR, GRS, GRT, GRV, GRY, GSI, GSK, GSL, GSR, GTI, GTK, GTL, GTR, GVF, GVI, GVK, GVL, GVR, GVY, GYK, GYR, IGA, IGF, IGI, IGK, IGL, IGN, IGQ, IGR, IGS, IGT, IGV, IGY, IIG, IIK, IIR, IKA, IKF, IKG, IKI, IKK, IKL, IKN, IKQ, IKR, IKS, IKT, IKV, IKY, ILG, ILK, ILR, INA, ING, INK, INR, INV, IPG, IPK, IPR, IQA, IQG, IQK, IQR, IQV, IRA, IRF, IRG, IRI, IRK, IRL, IRN, IRQ, IRR, IRS, IRT, IRV, IRY, ISG, ISK, ISR, ITG, ITK, ITR, KAF, KAG, KAI, KAK, KAL, KAR, KAY, KFF, KFG, KFK, KFR, KGA, KGD, KGE, KGF, KGI, KGK, KGL, KGN, KGQ, KGR, KGS, KGT, KGV, KGY, KIG, KIK, KIN, KIQ, KIR, KKA, KKD, KKE, KKF, KKG, KKN, KKQ, KKS, KKT, KKV, KKY, KLG, KLK, KLN, KLQ, KLR, KNG, KNK, KNR, KPG, KPK, KPR, KQG, KQK, KQR, KRA, KRD, KRE, KRF, KRG, KRN, KRQ, KRS, KRT, KRV, KRY, KSG, KSI, KSK, KSL, KSR, KTG, KTI, KTK, KTL, KTR, KVF, KVG, KVI, KVK, KVL, KVR, KVY, KYG, KYK, KYR, LFR, LGA, LGF, LGI, LGK, LGL, LGN, LGQ, LGR, LGS, LGT, LGV, LGY, LIG, LIK, LIR, LK, LKA, LKF, LKG, LKI, LKK, LKL, LKN, LKQ, LKR, LKS, LKT, LKV, LKY, LLG, LLK, LLR, LNA, LNG, LNK, LNR, LNV, LPG, LPK, LPR, LQA, LQG, LQK, LQR, LQV, LRA, LRF, LRG, LRI, LRK, LRL, LRN, LRQ, LRR, LRS, LRT, LRV, LRY, LSG, LSK, LSR, LTG, LTK, LTR, NGK, NGR, NIG, NIK, NIR, NLG, NLK, NLR, PGK, PGR, PIG, PIK, PIR, PKG, PKK, PKR, PLG, PLK, PLR, PRG, PRK, PRR, QGK, QGR, QIG, QIK, QIR, QLG, QLK, QLR, RAF, RAG, RAI, RAK, RAL, RAR, RAY, RFF, RFG, RFK, RFR, RGA, RGD, RGE, RGF, RGI, RGK, RGL, RGN, RGQ, RGR, RGS, RGT, RGV, RGY, RIG, RIK, RIN, RIQ, RIR, RKA, RKD, RKE, RKF, RKG, RKK, RKN, RKQ, RKS, RKT, RKV, RKY, RLF, RLFL, RLG, RLK, RLN, RLQ, RLR, RNG, RNK, RNR, RPG, RPK, RPR, RQG, RQK, RQR, RRA, RRD, RRE, RRF, RRG, RRK, RRN, RRQ, RRR, RRS, RRT, RRV, RRY, RSG, RSI, RSK, RSL, RSR, RTG, RTI, RTK, RTL, RTR, RVF, RVG, RVI, RVK, RVL, RVR, RVY, RYG, RYK, RYR, VAG, VAK, VAR, VFG, VFK, VFR, VGF, VGI, VGK, VGL, VGN, VGQ, VGR, VGS, VGT, VGY, VIG, VIK, VIN, VIQ, VIR, VKF, VKG, VKI, VKK, VKL, VKN, VKQ, VKR, VKS, VKT, VKY, VLG, VLK, VLN, VLQ, VLR, VPG, VPK, VPR, VR, VRF, VRG, VRI, VRK, VRL, VRN, VRQ, VRR, VRS, VRT, VRY, VSG, VSK, VSR, VTG, VTK, VTR, VVG, VVK, VVR, VYG, VYK, or VYR.

In various embodiments, exemplary X region peptide sequences, i.e., peptide sequences that may be cleaved by one or more insect and/or nematode proteases found in the insect and/or nematode gut/hemolymph environment may include: AAK, AAR, AFK, AFR, AIK, AIN, AIQ, AIR, AKF, AKI, AKK, AKL, AKN, AKQ, AKR, AKS, AKT, AKY, ALK, ALN, ALQ, ALR, APK, APR, ARF, ARI, ARK, ARL, ARN, ARQ, ARR, ARS, ART, ARY, ASK, ASR, ATK, ATR, AVK, AVR, AYK, AYR, DIK, DIR, DLK, DLR, EIK, EIR, ELK, ELR, IIK, IIR, IKA, IKF, IKI, IKK, IKL, IKN, IKQ, IKR, IKS, IKT, IKV, IKY, ILK, ILR, INA, INK, INR, INV, IPK, IPR, IQA, IQK, IQR, IQV, IRA, IRF, IRI, IRK, IRL, IRN, IRQ, IRR, IRS, IRT, IRV, IRY, ISK, ISR, ITK, ITR, KAF, KAI, KAK, KAL, KAR, KAY, KFK, KFR, KIK, KIN, KIQ, KIR, KKA, KKD, KKE, KKF, KKN, KKQ, KKS, KKT, KKV, KKY, KLK, KLN, KLQ, KLR, KNK, KNR, KPK, KPR, KQK, KQR, KRA, KRD, KRE, KRF, KRN, KRQ, KRS, KRT, KRV, KRY, KSI, KSK, KSL, KSR, KTI, KTK, KTL, KTR, KVF, KVI, KVK, KVL, KVR, KVY, KYK, KYR, LIK, LIR, LKA, LKF, LKI, LKK, LKL, LKN, LKQ, LKR, LKS, LKT, LKV, LKY, LLK, LLR, LNA, LNK, LNR, LNV, LPK, LPR, LQA, LQK, LQR, LQV, LRA, LRF, LRI, LRK, LRL, LRN, LRQ, LRR, LRS, LRT, LRV, LRY, LSK, LSR, LTK, LTR, NIK, NIR, NLK, NLR, PIK, PIR, PKK, PKR, PLK, PLR, PRK, PRR, QIK, QIR, QLK, QLR, RAF, RAI, RAK, RAL, RAR, RAY, RFK, RFR, RIK, RIN, RIQ, RIR, RKA, RKD, RKE, RKF, RKN, RKQ, RKS, RKT, RKV, RKY, RLK, RLN, RLQ, RLR, RNK, RNR, RPK, RPR, RQK, RQR, RRA, RRD, RRE, RRF, RRN, RRQ, RRS, RRT, RRV, RRY, RSI, RSK, RSL, RSR, RTI, RTK, RTL, RTR, RVF, RVI, RVK, RVL, RVR, RVY, RYK, RYR, VAK, VAR, VFK, VFR, VIK, VIN, VIQ, VIR, VKF, VKI, VKK, VKL, VKN, VKQ, VKR, VKS, VKT, VKY, VLK, VLN, VLQ, VLR, VPK, VPR, VRF, VRI, VRK, VRL, VRN, VRQ, VRR, VRS, VRT, VRY, VSK, VSR, VTK, VTR, VVK, VVR, VYK, or VYR.

In various embodiments, exemplary Y region peptide sequences, i.e., peptide sequences that may be cleaved by one or more animal, for example human proteases found in the animal, for example, a human gastrointestinal environment may include: AFF, AFG, AFI, AFL, AFV, AFY, AGF, AGL, AIF, AIL, ALF, ALG, ALI, ALL, ALY, AYF, AYL, DFF, DFG, DFI, DFL, DFY, DGF, DGL, DIF, DLF, DLG, DLY, DYF, DYL, EFF, EFG, EFI, EFL, EFY, EGF, EGL, EIF, ELF, ELG, ELY, EYF, EYL, FF, FFA, FFD, FFE, FFF, FFG, FFI, FFK, FFL, FFR, FFS, FFT, FFV, FFY, FGA, FGD, FGE, FGF, FGI, FGK, FGL, FGR, FGS, FGT, FGV, FGY, FLV, FLR, FYA, FYD, FYE, FYF, FYG, FYI, FYK, FYL, FYR, FYS, FYT, FYV, FYY, GFA, GFD, GFE, GFF, GFI, GFK, GFL, GFR, GFS, GFT, GFV, GFY, GGL, GIF, GIL, GLF, GLI, GLL, GLY, GYF, GYL, IF, IFA, IFF, IFG, IFI, IFL, IFV, IFY, IGF, IGL, IIF, IIL, ILF, ILG, ILI, ILL, ILY, IYF, IYL, LFA, LFF, LFG, LFI, LFL, LFV, LFY, LG, LGA, LGE, LGF, LGI, LGL, LGV, LGY, LIF, LIG, LII, LIL, LIY, LLF, LLG, LLI, LLL, LLY, LYA, LYF, LYG, LYI, LYL, LYV, LYY, NFF, NFG, NFI, NFL, NFY, NGF, NGL, NIL, NLG, NLI, NLL, NYF, NYL, QFF, QFG, QFI, QFL, QFY, QGF, QGL, QIL, QLG, QLI, QLL, QYF, QYL, SFF, SFG, SFI, SFL, SFY, SGF, SGL, SIF, SIL, SLF, SLG, SLI, SLL, SLY, SYF, SYL, TFF, TFG, TFI, TFL, TFY, TGF, TGL, TIF, TIL, TLF, TLG, TLI, TLL, TLY, TYF, TYL, VFF, VFG, VFI, VFL, VFY, VGF, VGL, VIF, VIL, VLF, VLG, VLI, VLL, VLY, VYF, VYL, YFA, YFD, YFE, YFF, YFG, YFI, YFK, YFL, YFR, YFS, YFT, YFV, YFY, YGF, YGL, YYF, or YYL.

In various embodiments, exemplary Y region peptide sequences, i.e., peptide sequences that may be cleaved by one or more animal, for example a human protease found in the animal, for example, a human gastrointestinal environment may include: AFF, AFI, AFL, AFY, AIF, AIL, ALF, ALI, ALL, ALY, AYF, AYL, DFF, DFI, DFL, DFY, DIF, DLF, DLY, DYF, DYL, YFL, EFF, EFI, EFL, 0, EFY, EIF, ELF, ELY, EYF, EYL, FFA, FFD, FFE, FFF, FFI, FFK, FFL, FFR, FFS, FFT, FFV, FFY, FYA, FYD, FYE, FYF, FYI, FYK, FYL, FYR, FYS, FYT, FYV, FYY, IFA, IFF, IFI, IFL, IFV, IFY, IIF, IIL, ILF, ILI, ILL, ILY, IYF, IYL, LFA, LFF, LFI, LFL, LFV, LFY, LIF, LII, LIL, LIY, LLF, LLI, LLL, LLY, LYA, LYF, LYI, LYL, LYV, LYY, NFF, NFI, NFL, NFY, NIL, NLI, NLL, NYF, NYL, QFF, QFI, QFL, QFY, QIL, QLI, QLL, QYF, QYL, SFF, SFI, SFL, SFY, SIF, SIL, SLF, SLI, SLL, SLY, SYF, SYL, TFF, TFI, TFL, TFY, TIF, TIL, TLF, TLI, TLL, TLY, TYF, TYL, VFF, VFI, VFL, VFY, VIF, VIL, VLF, VLI, VLL, VLY, VYF, VYL, YFA, YFD, YFE, YFF, YFI, YFK, YFL, YFR, YFS, YFT, YFV, YFY, YYF, or YYL.

In various embodiments, exemplary X or Y region peptide sequences, i.e. peptide sequences that may be cleaved by one or more animal, for example, human protease found in the animal, for example, a human gastrointestinal environment, and one or more insect and/or nematode proteases found in the insect and/or nematode gut/hemolymph environment may include: AFG, AGF, AGL, ALG, DLG, ELG, GFK, GFR, IGF, IGL, ILG, LGA, LGF, LGI, LGL, LGV, LGY, LIG, LLG, NLG, QLG, VFG, VGF, VGL, or VLG.

In some illustrative examples, a binary peptide of the present invention can comprise the formula: $X_1$-$X_2$-$Y_1$-$Y_2$, $X_1$-$X_2$-$X_3$-$Y_1$-$Y_2$, $X_1$-$X_2$-$X_3$-$X_4$-$Y_1$-$Y_2$, $X_1$-$X_2$-$Y_1$-$Y_2$-$Y_3$, $X_1$- $X_2$-$X_3$-$Y_1$-$Y_2$-$Y_3$, $X_1$-$X_2$-$X_3$-$X_4$-$Y_1$-$Y_2$-$Y_3$, $X_1$-$X_2$-$Y_1$-$Y_2$-$Y_3$-$Y_4$, $X_1$-$X_2$-$X_3$-$Y_1$-$Y_2$-$Y_3$-$Y_4$, $X_1$-$X_2$-$X_3$-$X_4$-$Y_1$-$Y_2$-$Y_3$-$Y_4$, $Y_1$-$Y_2$-$X_1$-$X_2$, $Y_1$-$Y_2$-$X_1$-$X_2$-$X_3$, $Y_1$-$Y_2$-$X_1$-$X_2$-$X_3$-$X_4$, $Y_1$-$Y_2$-$Y_3$-$X_1$-$X_2$, $Y_1$-$Y_2$-$Y_3$-$X_1$-$X_2$-$X_3$, $Y_1$-$Y_2$-$Y_3$-$X_1$-$X_2$-$X_3$-$X_4$, $Y_1$-$Y_2$-$Y_3$-$Y_4$-$X_1$-$X_2$, $Y_1$-$Y_2$-$Y_3$-$Y_4$-$X_1$-$X_2$-$X_3$, $Y_1$-$Y_2$-$Y_3$-$Y_4$-$X_1$-$X_2$-$X_3$-$X_4$, wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

In some embodiments, illustrative binary peptides (XY or YX) comprise the following amino acid sequences: AFVRLF (SEQ ID NO: 1594), AKLFV (SEQ ID NO: 1595), ALFALK (SEQ ID NO: 1596), ALFLK (SEQ ID NO: 1597), ALFLR (SEQ ID NO: 1598), ALFR (SEQ ID NO: 1599), ALFRLR (SEQ ID NO: 1600), ALKALF (SEQ ID NO: 1601), ALKFF (SEQ ID NO: 1602), ALKFLV (SEQ ID NO: 1603), ALKIFV (SEQ ID NO: 1604), ALKLFV (SEQ ID NO: 1605), FFADIK (SEQ ID NO: 1606), FFALK (SEQ ID NO: 1607), FFLK (SEQ ID NO: 1608), FFLR (SEQ ID NO: 1609), FFRLR (SEQ ID NO: 1610), FGYRIK (SEQ ID NO: 1611), FLRLF (SEQ ID NO: 1612), FYARR (SEQ ID NO: 1613), GGLRKK (SEQ ID NO: 1614), IFVALK (SEQ ID NO: 1615), IFVLK (SEQ ID NO: 1616), IFVLR (SEQ ID NO: 1617), IFVR (SEQ ID NO: 1618), IFVRLR (SEQ ID NO: 1619), ILFNIK (SEQ ID NO: 1620), LFAAPF (SEQ ID NO: 1621), FVALK (SEQ ID NO: 1622), LFVLK (SEQ ID NO: 1623), LFVLR (SEQ ID NO: 1624), LFVR (SEQ ID NO: 1625), LFVRLR (SEQ ID NO: 1626), LFVRVFL (SEQ ID NO: 1627), LGER (SEQ ID NO: 1628), LKALF (SEQ ID NO: 1629), LKFF (SEQ ID NO: 1630), LKIFV (SEQ ID NO: 1631), LKLFV (SEQ ID NO: 1632), LRALF (SEQ ID NO: 1633), LRFF (SEQ ID NO: 1634), LRIFV (SEQ ID NO: 1635), LRLFV (SEQ ID NO: 1636), RALF (SEQ ID NO: 1637), RIFV (SEQ ID NO: 1638), RLFV (SEQ ID NO: 1639), RLRALF (SEQ ID NO: 1640), RLRFF (SEQ ID NO: 1641), RLRIFV (SEQ ID NO: 1642), RLRLFV (SEQ ID NO: 1643), RRKAFV (SEQ ID NO: 1644), RRKLIF (SEQ ID NO: 1645), RRRFFA (SEQ ID NO: 1646), VFGRKG (SEQ ID NO: 1647), and YFVRK (SEQ ID NO: 1648).

In various embodiments, exemplary binary peptides for use in the insecticidal and/or nematicidal polypeptides and proteins, DNA constructs and incorporated into transgenic plants or parts thereof, of the present invention may include one or more cleavable binary peptides selected from the group of or consisting of: IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621).

(1C). Descriptions and Examples of Tertiary Peptides

In various embodiments, tertiary peptides can include all of the illustrative binary peptides illustrated above with the addition of 1 to 4 amino acids fused in frame to the N-terminus, the C-terminus or both termini of the binary peptide. In some embodiments, the tertiary peptides of the present invention can include all of the illustrative binary peptides disclosed above having one, two, three or four amino acids fused in frame to the N-terminus, the C-terminus, or both termini of an exemplary binary peptide. In another example, an illustrative tertiary peptide can include an $X_{(2-4)}Y_{(2-4)}$, or $Y_{(2-4)}X_{(2-4)}$, with the addition of a $Z_{(1-4)}$ positioned in frame with the N-terminus, or the C-terminus or both termini, of a binary peptide as defined above. In some illustrative examples, various tertiary peptide examples can include the amino acid sequence: $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2-X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2-X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3-Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3-Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1-Y_2-Y_3-Y_4-Z_1$, $Z_1-X_1-X_2-Y_1-Y_2-Z_1$, $Z_1-X_1-X_2-X_3-Y_1-Y_2-Z_1$, $Z_1-X_1-X_2-X_3-X_4-Y_1-Y_2-Z_1$, $Z_1-X_1-X_2-Y_1-Y_2-Y_3-Z_1$, $Z_1-X_1-X_2-X_3-Y_1-Y_2-Y_3-Z_1$, $Z_1-X_1-X_2-X_3-X_4-Y_1-Y_2-Y_3-Z_1$, $Z_1-X_1-X_2-Y_1-Y_2-Y_3-Y_4-Z_1$, $Z_1-X_1-X_2-X_3-Y_1-Y_2-Y_3-Y_4-Z_1$, $Z_1-X_1-X_2-X_3-X_4-Y_1-Y_2-Y_3-Y_4-Z_1$, $Z_1-Z_2-X_1-X_2-Y_1-Y_2-Z_1$, $Z_1-Z_2-X_1-X_2-X_3-Y_1-Y_2-Z_1$, $Z_1-Z_2-X_1-X_2-X_3-X_4-Y_1-Y_2-Z_1$, $Z_1-Z_2-X_1-X_2-Y_1-Y_2-Y_3-Z_1$, $Z_1-Z_2-X_1-X_2-X_3-Y_1-Y_2-Y_3-Z_1$, $Z_1-Z_2-X_1-X_2-X_3-X_4-Y_1-Y_2-Y_3-Z_1$, $Z_1-Z_2-X_1-X_2-Y_1-Y_2-Y_3-Y_4-Z_1$, $Z_1-Z_2-X_1-X_2-X_3-Y_1-Y_2-Y_3-Y_4-Z_1$, $Z_1-Z_2-X_1-X_2-X_3-X_4-Y_1-Y_2-Y_3-Y_4-Z_1$, $Z_1-Z_2-Z_3-X_1-X_2-Y_1-Y_2-Z_1$, $Z_1-Z_2-Z_3-X_1-X_2-X_3-Y_1-Y_2-Z_1$, $Z_1-Z_2-Z_3-X_1-X_2-X_3-X_4-Y_1-Y_2-Z_1$, $Z_1-Z_2-Z_3-X_1-X_2-Y_1-Y_2-Y_3-Z_1$, $Z_1-Z_2-Z_3-X_1-X_2-X_3-Y_1-Y_2-Y_3-Z_1$, $Z_1-Z_2-Z_3-X_1-X_2-X_3-X_4-Y_1-Y_2-Y_3-Z_1$, $Z_1-Z_2-Z_3-X_1-X_2-Y_1-Y_2-Y_3-Y_4-Z_1$, $Z_1-Z_2-Z_3-X_1-X_2-X_3-Y_1-Y_2-Y_3-Y_4-Z_1$, $Z_1-Z_2-Z_3-X_1-X_2-X_3-X_4-Y_1-Y_2-Y_3-Y_4-Z_1$, $Z_1-Z_2-Z_3-Z_4-X_1-X_2-Y_1-Y_2-Z_1$, $Z_1-Z_2-Z_3-Z_4-X_1-X_2-X_3-Y_1-Y_2-Z_1$, $Z_1-Z_2-Z_3-Z_4-X_1-X_2-X_3-X_4-Y_1-Y_2-Z_1$, $Z_1-Z_2-Z_3-Z_4-X_1-X_2-Y_1-Y_2-Y_3-Z_1$, $Z_1-Z_2-Z_3-Z_4-X_1-X_2-X_3-Y_1-Y_2-Y_3-Z_1$, $Z_1-Z_2-Z_3-Z_4-X_1-X_2-X_3-X_4-Y_1-Y_2-Y_3-Z_1$, $Z_1-Z_2-Z_3-Z_4-X_1-X_2-Y_1-Y_2-Y_3-Y_4-Z_1$, $Z_1-Z_2-Z_3-Z_4-X_1-X_2-X_3-Y_1-Y_2-Y_3-Y_4-Z_1$, $Z_1-Z_2-Z_3-Z_4-X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $Z_1-X_1-X_2-Y_1-Y_2-Z_1-Z_2$, $Z_1-X_1-X_2-X_3-Y_1-Y_2-Z_1-Z_2$, $Z_1-X_1-X_2-X_3-X_4-Y_1-Y_2-Z_1-Z_2$, $Z_1-X_1-X_2-Y_1-Y_2-Y_3-Z_1-Z_2$, $Z_1-X_1-X_2-X_3-Y_1-Y_2-Y_3-Z_1-Z_2$, $Z_1-X_1-X_2-X_3-X_4-Y_1-Y_2-Y_3-Z_1-Z_2$, $Z_1-X_1-X_2-Y_1-Y_2-Y_3-Y_4-Z_1-Z_2$, $Z_1-X_1-X_2-X_3-Y_1-Y_2-Y_3-Y_4-Z_1-Z_2$, $Z_1-X_1-X_2-X_3-X_4-Y_1-Y_2-Y_3-Y_4-Z_1-Z_2$, $Z_1-Z_2-X_1-X_2-Y_1-Y_2-Z_1-Z_2$, $Z_1-Z_2-X_1-X_2-X_3-Y_1-Y_2-Z_1-Z_2$, $Z_1-Z_2-X_1-X_2-X_3-X_4-Y_1-Y_2-Z_1-Z_2$, $Z_1-Z_2-X_1-X_2-Y_1-Y_2-Y_3-Z_1-Z_2$, $Z_1-Z_2-X_1-X_2-X_3-Y_1-Y_2-Y_3-Z_1-Z_2$, $Z_1-Z_2-X_1-X_2-X_3-X_4-Y_1-Y_2-Y_3-Z_1-Z_2$, $Z_1-Z_2-X_1-X_2-Y_1-Y_2-Y_3-Y_4-Z_1-Z_2$, $Z_1-Z_2-X_1-X_2-X_3-Y_1-Y_2-Y_3-Y_4-Z_1-Z_2$, $Z_1-Z_2-X_1-X_2-X_3-X_4-Y_1-Y_2-Y_3-Y_4-Z_1-Z_2$, $Z_1-Z_2-Z_3-X_1-X_2-Y_1-Y_2-Z_1-Z_2$, $Z_1-Z_2-Z_3-X_1-X_2-X_3-Y_1-Y_2-Z_1-Z_2$, $Z_1-Z_2-Z_3-X_1-X_2-X_3-X_4-Y_1-Y_2-Z_1-Z_2$, $Z_1-Z_2-Z_3-X_1-X_2-Y_1-Y_2-Y_3-Z_1-Z_2$, $Z_1-Z_2-Z_3-X_1-X_2-X_3-Y_1-Y_2-Y_3-Z_1-Z_2$, $Z_1-Z_2-Z_3-X_1-X_2-X_3-X_4-Y_1-Y_2-Y_3-Z_1-Z_2$, $Z_1-Z_2-Z_3-X_1-X_2-Y_1-Y_2-Y_3-Y_4-Z_1-Z_2$, $Z_1-Z_2-Z_3-X_1-X_2-X_3-Y_1-Y_2-Y_3-Y_4-Z_1-Z_2$, $Z_1-Z_2-Z_3-X_1-X_2-X_3-X_4-Y_1-Y_2-Y_3-Y_4-Z_1-Z_2$, $Z_1-Z_2-Z_3-Z_4-X_1-X_2-Y_1-Y_2-Z_1-Z_2$, $Z_1-Z_2-Z_3-Z_4-X_1-X_2-X_3-Y_1-Y_2-Z_1-Z_2$, $Z_1-Z_2-Z_3-Z_4-X_1-X_2-X_3-X_4-Y_1-Y_2-Z_1-Z_2$, $Z_1-Z_2-Z_3-Z_4-X_1-X_2-Y_1-Y_2-Y_3-Z_1-Z_2$, $Z_1-Z_2-Z_3-Z_4-X_1-X_2-X_3-Y_1-Y_2-Y_3-Z_1-Z_2$, $Z_1-Z_2-Z_3-Z_4-X_1-X_2-X_3-X_4-Y_1-Y_2-Y_3-Z_1-Z_2$, $Z_1-Z_2-Z_3-Z_4-X_1-X_2-Y_1-Y_2-Y_3-Y_4-Z_1-Z_2$, $Z_1-Z_2-Z_3-Z_4-X_1-X_2-X_3-Y_1-Y_2-Y_3-Y_4-Z_1-Z_2$, $Z_1-Z_2-Z_3-Z_4-X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $Z_1-X_1-X_2-Y_1-Y_2-Z_1-Z_2-Z_3$, $Z_1-X_1-X_2-X_3-Y_1-Y_2-Z_1-Z_2-Z_3$, $Z_1-X_1-X_2-X_3-X_4-Y_1-Y_2-Z_1-Z_2-Z_3$, $Z_1-X_1-X_2-Y_1-Y_2-Y_3-Z_1-Z_2-Z_3$, $Z_1-X_1-X_2-X_3-Y_1-Y_2-Y_3-Z_1-Z_2-Z_3$, $Z_1-X_1-X_2-X_3-X_4-Y_1-Y_2-Y_3-Z_1-Z_2-Z_3$, $Z_1-X_1-X_2-Y_1-Y_2-Y_3-Y_4-Z_1-Z_2-Z_3$, $Z_1-X_1-X_2-X_3-Y_1-Y_2-Y_3-Y_4-Z_1-Z_2-Z_3$, $Z_1-X_1-X_2-X_3-X_4-Y_1-Y_2-Y_3-Y_4-Z_1-Z_2-Z_3$, $Z_1-Z_2-X_1-X_2-Y_1-Y_2-Z_1-Z_2-Z_3$, $Z_1-Z_2-X_1-X_2-X_3-Y_1-Y_2-Z_1-Z_2-Z_3$, $Z_1-Z_2-X_1-X_2-X_3-X_4-Y_1-Y_2-Z_1-Z_2-Z_3$, $Z_1-Z_2-X_1-X_2-Y_1-Y_2-Y_3-Z_1-Z_2-Z_3$, $Z_1-Z_2-X_1-X_2-X_3-Y_1-Y_2-Y_3-Z_1-Z_2-Z_3$, $Z_1-Z_2-X_1-X_2-X_3-X_4-Y_1-Y_2-Y_3-Z_1-Z_2-Z_3$, $Z_1-Z_2-X_1-X_2-Y_1-Y_2-Y_3-Y_4-Z_1-Z_2-Z_3$, $Z_1-Z_2-X_1-X_2-X_3-Y_1-Y_2-Y_3-Y_4-Z_1-Z_2-Z_3$, $Z_1-Z_2-X_1-X_2-X_3-X_4-Y_1-Y_2-Y_3-Y_4-Z_1-Z_2-Z_3$, $Z_1-Z_2-Z_3-X_1-X_2-Y_1-Y_2-Z_1-Z_2-Z_3$, $Z_1-Z_2-Z_3-X_1-X_2-X_3-Y_1-Y_2-Z_1-Z_2-Z_3$, $Z_1-Z_2-Z_3-X_1-X_2-X_3-X_4-Y_1-Y_2-Z_1-Z_2-Z_3$, $Z_1-Z_2-Z_3-X_1-X_2-Y_1-Y_2-Y_3-Z_1-Z_2-Z_3$, $Z_1-Z_2-Z_3-X_1-X_2-X_3-Y_1-Y_2-Y_3-Z_1-Z_2-Z_3$, $Z_1-Z_2-Z_3-X_1-X_2-X_3-X_4-Y_1-Y_2-Y_3-Z_1-Z_2-Z_3$, $Z_1-Z_2-Z_3-X_1-X_2-Y_1-Y_2-Y_3-Y_4-Z_1-Z_2-Z_3$, $Z_1-Z_2-Z_3-X_1-X_2-X_3-Y_1-Y_2-Y_3-Y_4-Z_1-Z_2-Z_3$, $Z_1-Z_2-Z_3-X_1-X_2-X_3-X_4-Y_1-Y_2-Y_3-Y_4-Z_1-Z_2-Z_3$, $Z_1-Z_2-Z_3-Z_4-X_1-X_2-Y_1-Y_2-Z_1-Z_2-Z_3$, $Z_1-Z_2-Z_3-Z_4-X_1-X_2-X_3-Y_1-Y_2-Z_1-Z_2-Z_3$, $Z_1-Z_2-Z_3-Z_4-X_1-X_2-X_3-X_4-Y_1-Y_2-Z_1-Z_2-Z_3$, $Z_1-Z_2-Z_3-Z_4-X_1-X_2-Y_1-Y_2-Y_3-Z_1-Z_2-Z_3$, $Z_1-Z_2-Z_3-Z_4-X_1-X_2-X_3-Y_1-Y_2-Y_3-Z_1-Z_2-Z_3$, $Z_1-Z_2-Z_3-Z_4-X_1-X_2-X_3-X_4-Y_1-Y_2-Y_3-Z_1-Z_2-Z_3$, $Z_1-Z_2-Z_3-Z_4-X_1-X_2-Y_1-Y_2-Y_3-Y_4-Z_1-Z_2-Z_3$, $Z_1-Z_2-Z_3-Z_4-X_1-X_2-X_3-Y_1-Y_2-Y_3-Y_4-Z_1-Z_2-Z_3$, $Z_1-Z_2-Z_3-Z_4-X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Z_1-X_1-X_2-Y_1-Y_2-Z_1-Z_2-Z_3-Z_4$, $Z_1-X_1-X_2-X_3-Y_1-Y_2-Z_1-Z_2-Z_3-Z_4$, $Z_1-X_1-X_2-X_3-X_4-Y_1-Y_2-Z_1-Z_2-Z_3-Z_4$, $Z_1-X_1-X_2-Y_1-Y_2-Y_3-Z_1-Z_2-Z_3-Z_4$, $Z_1-X_1-X_2-X_3-Y_1-Y_2-Y_3-Z_1-Z_2-Z_3-Z_4$, $Z_1-X_1-X_2-X_3-X_4-Y_1-Y_2-Y_3-Z_1-Z_2-Z_3-Z_4$, $Z_1-X_1-X_2-Y_1-Y_2-Y_3-Y_4-Z_1-Z_2-Z_3-Z_4$, $Z_1-X_1-X_2-X_3-Y_1-Y_2-Y_3-Y_4-Z_1-Z_2-Z_3-Z_4$, $Z_1-X_1-X_2-X_3-X_4-Y_1-Y_2-Y_3-Y_4-Z_1-Z_2-Z_3-Z_4$, $Z_1-Z_2-X_1-X_2-Y_1-Y_2-Z_1-Z_2-Z_3-Z_4$, $Z_1-Z_2-X_1-X_2-X_3-Y_1-Y_2-Z_1-Z_2-Z_3-Z_4$, $Z_1-Z_2-X_1-X_2-X_3-X_4-Y_1-Y_2-Z_1-Z_2-Z_3-Z_4$, $Z_1-Z_2-X_1-X_2-Y_1-Y_2-Y_3-Z_1-Z_2-Z_3-Z_4$, $Z_1-Z_2-X_1-X_2-X_3-Y_1-Y_2-Y_3-Z_1-Z_2-Z_3-$ $Z_4$, $Z_1-Z_2-X_1-X_2-X_3-X_4-Y_1-Y_2-Y_3-Z_1-Z_2-Z_3-Z_4$, $Z_1-Z_2-X_1-X_2-Y_1-Y_2-Y_3-Y_4-Z_1-Z_2-Z_3-Z_4$, $Z_1-Z_2-X_1-X_2-X_3-Y_1-Y_2-Y_3-Y_4-Z_1-Z_2-Z_3-Z_4$, $Z_1-Z_2-X_1-X_2-X_3-X_4-Y_1-Y_2-Y_3-Y_4-Z_1-Z_2-Z_3-Z_4$, $Z_1-Z_2-Z_3-X_1-X_2-Y_1-Y_2-Z_1-Z_2-Z_3-Z_4$, $Z_1-Z_2-Z_3-X_1-X_2-X_3-Y_1-Y_2-Z_1-Z_2-Z_3-Z_4$, $Z_1-Z_2-Z_3-X_1-X_2-X_3-X_4-Y_1-Y_2-Z_1-Z_2-Z_3-Z_4$, $Z_1-Z_2-Z_3-X_1-X_2-Y_1-Y_2-Y_3-Z_1-Z_2-Z_3-Z_4$, $Z_1-Z_2-Z_3-X_1-X_2-X_3-Y_1-Y_2-Y_3-Z_1-Z_2-Z_3-Z_4$, $Z_1-Z_2-Z_3-X_1-X_2-X_3-X_4-Y_1-Y_2-Y_3-Z_1-Z_2-Z_3-Z_4$, $Z_1-Z_2-Z_3-X_1-X_2-Y_1-Y_2-Y_3-Y_4-Z_1-Z_2-Z_3-Z_4$, $Z_1-Z_2-Z_3-X_1-X_2-X_3-Y_1-Y_2-Y_3-Y_4-Z_1-Z_2-Z_3-Z_4$, $Z_1-Z_2-Z_3-X_1-X_2-X_3-X_4-Y_1-Y_2-Y_3-Y_4-Z_1-Z_2-Z_3-Z_4$, $Z_1-Z_2-Z_3-Z_4-X_1-X_2-Y_1-Y_2-Z_1-Z_2-Z_3-Z_4$, $Z_1-Z_2-Z_3-Z_4-X_1-X_2-X_3-Y_1-Y_2-Z_1-Z_2-Z_3-Z_4$, $Z_1-Z_2-Z_3-Z_4-X_1-X_2-X_3-X_4-Y_1-Y_2-Z_1-Z_2-Z_3-Z_4$, $Z_1-Z_2-Z_3-Z_4-X_1-X_2-Y_1-Y_2-Y_3-Z_1-Z_2-Z_3-Z_4$, $Z_1-Z_2-Z_3-Z_4-X_1-X_2-X_3-Y_1-Y_2-Y_3-Z_1-Z_2-Z_3-Z_4$, $Z_1-Z_2-Z_3-Z_4-X_1-X_2-X_3-X_4-Y_1-Y_2-Y_3-Z_1-Z_2-Z_3-Z_4$, $Z_1-Z_2-Z_3-Z_4-X_1-X_2-Y_1-Y_2-Y_3-Y_4-Z_1-Z_2-Z_3-Z_4$, $Z_1-Z_2-Z_3-Z_4-X_1-X_2-X_3-Y_1-Y_2-Y_3-Y_4-Z_1-Z_2-Z_3-Z_4$, $Z_1-Z_2-Z_3-Z_4-X_1-X_2-X_3-X_4-Y_1-Y_2-Y_3-Y_4-Z_1-Z_2-Z_3-Z_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Z_1-Y_1-Y_2-X_1-X_2-Z_1$, $Z_1-Y_1-Y_2-X_1-X_2-X_3-Z_1$, $Z_1-Y_1-Y_2-X_1-X_2-X_3-X_4-Z_1$, $Z_1-Y_1-Y_2-Y_3-X_1-X_2-Z_1$, $Z_1-Y_1-Y_2-Y_3-X_1-X_2-X_3-Z_1$, $Z_1-Y_1-Y_2-Y_3-X_1-X_2-X_3-X_4-Z_1$, $Z_1-Y_1-Y_2-Y_3-Y_4-X_1-X_2-Z_1$, $Z_1-Y_1-Y_2-Y_3-Y_4-X_1-X_2-X_3-Z_1$, $Z_1-Y_1-Y_2-Y_3-Y_4-X_1-X_2-X_3-X_4-Z_1$, $Z_1-Z_2-Y_1-Y_2-X_1-X_2-Z_1$, $Z_1-Z_2-Y_1-Y_2-X_1-X_2-X_3-Z_1$, $Z_1-Z_2-Y_1-Y_2-X_1-X_2-X_3-X_4-Z_1$, $Z_1-Z_2-Y_1-Y_2-Y_3-X_1-X_2-Z_1$, $Z_1-Z_2-Y_1-Y_2-Y_3-X_1-X_2-X_3-Z_1$, $Z_1-Z_2-Y_1-Y_2-Y_3-X_1-X_2-X_3-X_4-Z_1$, $Z_1-Z_2-Y_1-Y_2-Y_3-Y_4-X_1-X_2-Z_1$, $Z_1-Z_2-Y_1-Y_2-Y_3-Y_4-X_1-X_2-X_3-Z_1$, $Z_1-Z_2-Y_1-Y_2-Y_3-Y_4-X_1-X_2-X_3-X_4-Z_1$, $Z_1-Z_2-Z_3-Y_1-Y_2-X_1-X_2-Z_1$, $Z_1-Z_2-Z_3-Y_1-Y_2-X_1-X_2-X_3-Z_1$, $Z_1-Z_2-Z_3-Y_1-Y_2-X_1-X_2-X_3-X_4-Z_1$, $Z_1-Z_2-Z_3-Y_1-Y_2-Y_3-X_1-X_2-Z_1$, $Z_1-Z_2-Z_3-Y_1-Y_2-Y_3-X_1-X_2-X_3-Z_1$, $Z_1-Z_2-Z_3-Y_1-Y_2-Y_3-X_1-X_2-X_3-X_4-Z_1$, $Z_1-Z_2-Z_3-Y_1-Y_2-Y_3-Y_4-X_1-X_2-Z_1$, $Z_1-Z_2-Z_3-Y_1-Y_2-Y_3-Y_4-X_1-X_2-X_3-Z_1$, $Z_1-Z_2-Z_3-Y_1-Y_2-Y_3-Y_4-X_1-X_2-X_3-X_4-Z_1$, $Z_1-Z_2-Z_3-Z_4-Y_1-Y_2-X_1-X_2-Z_1$, $Z_1-Z_2-Z_3-Z_4-Y_1-Y_2-X_1-X_2-X_3-Z_1$, $Z_1-Z_2-Z_3-Z_4-Y_1-Y_2-X_1-X_2-X_3-X_4-Z_1$, $Z_1-Z_2-Z_3-Z_4-Y_1-Y_2-Y_3-X_1-X_2-Z_1$, $Z_1-Z_2-Z_3-Z_4-Y_1-Y_2-Y_3-X_1-X_2-X_3-Z_1$, $Z_1-Z_2-Z_3-Z_4-Y_1-Y_2-Y_3-X_1-X_2-X_3-X_4-Z_1$, $Z_1-Z_2-Z_3-Z_4-Y_1-Y_2-Y_3-Y_4-X_1-X_2-Z_1$, $Z_1-Z_2-Z_3-Z_4-Y_1-Y_2-Y_3-Y_4-X_1-X_2-X_3-Z_1$, $Z_1-Z_2-Z_3-Z_4-Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Z_1-Y_1-Y_2-X_1-X_2-Z_1-Z_2$, $Z_1-Y_1-Y_2-X_1-X_2-X_3-Z_1-Z_2$, $Z_1-Y_1-Y_2-X_1-X_2-X_3-X_4-Z_1-Z_2$, $Z_1-Y_1-Y_2-Y_3-X_1-X_2-Z_1-Z_2$, $Z_1-Y_1-Y_2-Y_3-X_1-X_2-X_3-Z_1-Z_2$, $Z_1-Y_1-Y_2-Y_3-X_1-X_2-X_3-X_4-Z_1-Z_2$, $Z_1-Y_1-Y_2-Y_3-Y_4-X_1-X_2-Z_1-Z_2$, $Z_1-Y_1-Y_2-Y_3-Y_4-X_1-X_2-X_3-Z_1-Z_2$, $Z_1-Y_1-Y_2-Y_3-Y_4-X_1-X_2-X_3-X_4-Z_1-Z_2$, $Z_1-Z_2-Y_1-Y_2-X_1-X_2-Z_1-Z_2$, $Z_1-Z_2-Y_1-Y_2-X_1-X_2-X_3-Z_1-Z_2$, $Z_1-Z_2-Y_1-Y_2-X_1-X_2-X_3-X_4-Z_1-Z_2$, $Z_1-Z_2-Y_1-Y_2-Y_3-X_1-X_2-Z_1-Z_2$, $Z_1-Z_2-Y_1-Y_2-Y_3-X_1-X_2-X_3-Z_1-Z_2$, $Z_1-Z_2-Y_1-Y_2-Y_3-X_1-X_2-X_3-X_4-Z_1-Z_2$, $Z_1-Z_2-Y_1-Y_2-Y_3-Y_4-X_1-X_2-Z_1-Z_2$, $Z_1-Z_2-Y_1-Y_2-Y_3-Y_4-X_1-X_2-X_3-Z_1-Z_2$, $Z_1-Z_2-Y_1-Y_2-Y_3-Y_4-X_1-X_2-X_3-X_4-Z_1-Z_2$, $Z_1-Z_2-Z_3-Y_1-Y_2-X_1-X_2-Z_1-Z_2$, $Z_1-Z_2-Z_3-Y_1-Y_2-X_1-X_2-X_3-Z_1-Z_2$, $Z_1-Z_2-Z_3-Y_1-Y_2-X_1-X_2-X_3-X_4-Z_1-Z_2$, $Z_1-Z_2-Z_3-Y_1-Y_2-Y_3-X_1-X_2-Z_1-Z_2$, $Z_1-Z_2-Z_3-Y_1-Y_2-Y_3-X_1-X_2-X_3-Z_1-Z_2$, $Z_1-Z_2-Z_3-Y_1-Y_2-Y_3-X_1-X_2-X_3-X_4-Z_1-Z_2$, $Z_1-Z_2-Z_3-Y_1-Y_2-Y_3-Y_4-X_1-X_2-Z_1-Z_2$, $Z_1-Z_2-Z_3-Y_1-Y_2-Y_3-Y_4-X_1-X_2-X_3-Z_1-Z_2$, $Z_1-Z_2-Z_3-Y_1-Y_2-Y_3-Y_4-X_1-X_2-X_3-X_4-Z_1-Z_2$, $Z_1-Z_2-Z_3-Z_4-Y_1-Y_2-X_1-X_2-Z_1-Z_2$, $Z_1-Z_2-Z_3-Z_4-Y_1-Y_2-X_1-X_2-X_3-Z_1-Z_2$, $Z_1-Z_2-Z_3-Z_4-Y_1-Y_2-X_1-X_2-X_3-X_4-Z_1-Z_2$, $Z_1-Z_2-Z_3-Z_4-Y_1-Y_2-Y_3-X_1-X_2-Z_1-Z_2$, $Z_1-Z_2-Z_3-Z_4-Y_1-Y_2-Y_3-X_1-X_2-X_3-Z_1-Z_2$, $Z_1-Z_2-Z_3-Z_4-Y_1-Y_2-Y_3-X_1-X_2-X_3-X_4-Z_1-Z_2$, $Z_1-Z_2-Z_3-Z_4-Y_1-Y_2-Y_3-Y_4-X_1-X_2-Z_1-Z_2$, $Z_1-Z_2-Z_3-Z_4-Y_1-Y_2-Y_3-Y_4-X_1-X_2-X_3-Z_1-Z_2$, $Z_1-Z_2-Z_3-Z_4-Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Z_1-Y_1-Y_2-X_1-X_2-Z_1-Z_2-Z_3$, $Z_1-Y_1-Y_2-X_1-X_2-X_3-Z_1-Z_2-Z_3$, $Z_1-Y_1-Y_2-X_1-X_2-X_3-X_4-Z_1-Z_2-Z_3$, $Z_1-Y_1-Y_2-Y_3-X_1-X_2-Z_1-Z_2-Z_3$, $Z_1-Y_1-Y_2-Y_3-X_1-X_2-X_3-Z_1-Z_2-Z_3$, $Z_1-Y_1-Y_2-Y_3-X_1-X_2-X_3-X_4-Z_1-Z_2-Z_3$, $Z_1-Y_1-Y_2-Y_3-Y_4-X_1-X_2-Z_1-Z_2-Z_3$, $Z_1-Y_1-Y_2-Y_3-Y_4-X_1-X_2-X_3-Z_1-Z_2-Z_3$, $Z_1-Y_1-Y_2-Y_3-Y_4-X_1-X_2-X_3-X_4-Z_1-Z_2-Z_3$, $Z_1-Z_2-Y_1-Y_2-X_1-X_2-Z_1-Z_2-Z_3$, $Z_1-Z_2-Y_1-Y_2-X_1-X_2-X_3-Z_1-Z_2-Z_3$, $Z_1-Z_2-Y_1-Y_2-X_1-X_2-X_3-X_4-Z_1-Z_2-Z_3$, $Z_1-Z_2-Y_1-Y_2-Y_3-X_1-X_2-Z_1-Z_2-Z_3$, $Z_1-Z_2-Y_1-Y_2-Y_3-X_1-X_2-X_3-Z_1-Z_2-Z_3$, $Z_1-Z_2-Y_1-Y_2-Y_3-X_1-X_2-X_3-X_4-Z_1-Z_2-Z_3$, $Z_1-Z_2-Y_1-Y_2-Y_3-Y_4-X_1-X_2-Z_1-Z_2-Z_3$, $Z_1-Z_2-Y_1-Y_2-Y_3-Y_4-X_1-X_2-X_3-Z_1-Z_2-Z_3$, $Z_1-Z_2-Y_1-Y_2-Y_3-Y_4-X_1-X_2-X_3-X_4-Z_1-Z_2-Z_3$, $Z_1-Z_2-Z_3-Y_1-Y_2-X_1-X_2-Z_1-Z_2-Z_3$, $Z_1-Z_2-Z_3-Y_1-Y_2-X_1-X_2-X_3-Z_1-Z_2-Z_3$, $Z_1-Z_2-Z_3-Y_1-Y_2-X_1-X_2-X_3-X_4-Z_1-Z_2-Z_3$, $Z_1-Z_2-Z_3-Y_1-Y_2-Y_3-X_1-X_2-Z_1-Z_2-Z_3$, $Z_1-Z_2-Z_3-Y_1-Y_2-Y_3-X_1-X_2-X_3-Z_1-Z_2-Z_3$, $Z_1-Z_2-Z_3-Y_1-Y_2-Y_3-X_1-X_2-X_3-X_4-Z_1-Z_2-Z_3$, $Z_1-Z_2-Z_3-Y_1-Y_2-Y_3-Y_4-X_1-X_2-Z_1-Z_2-Z_3$, $Z_1-Z_2-Z_3-Y_1-Y_2-Y_3-Y_4-X_1-X_2-X_3-Z_1-Z_2-Z_3$, $Z_1-Z_2-Z_3-Y_1-Y_2-Y_3-Y_4-X_1-X_2-X_3-X_4-Z_1-Z_2-Z_3$, $Z_1-Z_2-Z_3-Z_4-Y_1-Y_2-X_1-X_2-Z_1-Z_2-Z_3$, $Z_1-Z_2-Z_3-Z_4-Y_1-Y_2-X_1-X_2-X_3-Z_1-Z_2-Z_3$, $Z_1-Z_2-Z_3-Z_4-Y_1-Y_2-X_1-X_2-X_3-X_4-Z_1-Z_2-Z_3$, $Z_1-Z_2-Z_3-Z_4-Y_1-Y_2-Y_3-X_1-X_2-Z_1-Z_2-Z_3$, $Z_1-Z_2-Z_3-Z_4-Y_1-Y_2-Y_3-X_1-X_2-X_3-Z_1-Z_2-Z_3$, $Z_1-Z_2-Z_3-Z_4-Y_1-Y_2-Y_3-X_1-X_2-X_3-X_4-Z_1-Z_2-Z_3$, $Z_1-Z_2-Z_3-Z_4-Y_1-Y_2-Y_3-Y_4-X_1-X_2-Z_1-Z_2-Z_3$, $Z_1-Z_2-Z_3-Z_4-Y_1-Y_2-Y_3-Y_4-X_1-X_2-X_3-Z_1-Z_2-Z_3$, $Z_1-Z_2-Z_3-Z_4-Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-Y_1-Y_2-X_1-X_2-Z_1-Z_2-Z_3-Z_4$, $Z_1-Y_1-Y_2-X_1-X_2-X_3-Z_1-Z_2-Z_3-Z_4$, $Z_1-Y_1-Y_2-X_1-X_2-X_3-X_4-Z_1-Z_2-Z_3-Z_4$, $Z_1-Y_1-Y_2-Y_3-X_1-X_2-Z_1-Z_2-Z_3-Z_4$, $Z_1-Y_1-Y_2-Y_3-X_1-X_2-X_3-Z_1-Z_2-Z_3-Z_4$, $Z_1-Y_1-Y_2-Y_3-X_1-X_2-X_3-X_4-Z_1-Z_2-Z_3-Z_4$, $Z_1-Y_1-Y_2-Y_3-Y_4-X_1-X_2-Z_1-Z_2-Z_3-Z_4$, $Z_1-Y_1-Y_2-Y_3-Y_4-X_1-X_2-X_3-Z_1-Z_2-Z_3-Z_4$, $Z_1-Y_1-Y_2-Y_3-Y_4-X_1-X_2-X_3-X_4-Z_1-Z_2-Z_3-Z_4$, $Z_1-Z_2-Y_1-Y_2-X_1-X_2-Z_1-Z_2-Z_3-Z_4$, $Z_1-Z_2-Y_1-Y_2-X_1-X_2-X_3-Z_1-Z_2-Z_3-Z_4$, $Z_1-Z_2-Y_1-Y_2-X_1-X_2-X_3-X_4-Z_1-Z_2-Z_3-Z_4$, $Z_1-Z_2-Y_1-Y_2-Y_3-X_1-X_2-Z_1-Z_2-Z_3-Z_4$, $Z_1-Z_2-Y_1-Y_2-Y_3-X_1-X_2-X_3-Z_1-Z_2-Z_3-Z_4$, $Z_1-Z_2-Y_1-Y_2-Y_3-X_1-X_2-X_3-X_4-Z_1-Z_2-Z_3-Z_4$, $Z_1-Z_2-Y_1-Y_2-Y_3-Y_4-X_1-X_2-Z_1-$ $Z_2-Z_3-Z_4$, $Z_1-Z_2-Y_1-Y_2-Y_3-Y_4-X_1-X_2-X_3-Z_1-Z_2-Z_3-Z_4$, $Z_1-Z_2-Y_1-Y_2-Y_3-Y_4-X_1-X_2-X_3-X_4-Z_1-Z_2-Z_3-Z_4$, $Z_1-Z_2-Z_3-Y_1-Y_2-X_1-X_2-Z_1-Z_2-Z_3-Z_4$, $Z_1-Z_2-Z_3-Y_1-Y_2-X_1-X_2-X_3-Z_1-Z_2-Z_3-Z_4$, $Z_1-Z_2-Z_3-Y_1-Y_2-X_1-X_2-X_3-X_4-Z_1-Z_2-Z_3-Z_4$, $Z_1-Z_2-Z_3-Y_1-Y_2-Y_3-X_1-X_2-Z_1-Z_2-Z_3-Z_4$, $Z_1-Z_2-Z_3-Y_1-Y_2-Y_3-X_1-X_2-X_3-Z_1-Z_2-Z_3-Z_4$, $Z_1-Z_2-Z_3-Y_1-Y_2-Y_3-X_1-X_2-X_3-X_4-Z_1-Z_2-Z_3-Z_4$, $Z_1-Z_2-Z_3-Y_1-Y_2-Y_3-Y_4-X_1-X_2-Z_1-Z_2-Z_3-Z_4$, $Z_1-Z_2-Z_3-Y_1-Y_2-Y_3-Y_4-X_1-X_2-X_3-Z_1-Z_2-Z_3-Z_4$, $Z_1-Z_2-Z_3-Y_1-Y_2-Y_3-Y_4-X_1-X_2-X_3-X_4-Z_1-Z_2-Z_3-Z_4$, $Z_1-Z_2-Z_3-Z_4-Y_1-Y_2-X_1-X_2-Z_1-Z_2-Z_3-Z_4$, $Z_1-Z_2-Z_3-Z_4-Y_1-Y_2-X_1-X_2-X_3-Z_1-Z_2-Z_3-Z_4$, $Z_1-Z_2-Z_3-Z_4-Y_1-Y_2-X_1-X_2-X_3-X_4-Z_1-Z_2-Z_3-Z_4$, $Z_1-Z_2-Z_3-Z_4-Y_1-Y_2-Y_3-X_1-X_2-Z_1-Z_2-Z_3-Z_4$, $Z_1-Z_2-Z_3-Z_4-Y_1-Y_2-Y_3-X_1-X_2-X_3-Z_1-Z_2-Z_3-Z_4$, $Z_1-Z_2-Z_3-Z_4-Y_1-Y_2-Y_3-X_1-X_2-X_3-X_4-Z_1-Z_2-Z_3-Z_4$, $Z_1-Z_2-Z_3-Z_4-Y_1-Y_2-Y_3-Y_4-X_1-X_2-Z_1-Z_2-Z_3-Z_4$, $Z_1-Z_2-Z_3-Z_4-Y_1-Y_2-Y_3-Y_4-X_1-X_2-X_3-Z_1-Z_2-Z_3-Z_4$, $Z_1-Z_2-Z_3-Z_4-Y_1-Y_2-Y_3-Y_4-X_1-X_2-X_3-X_4-Z_1-Z_2-Z_3-Z_4$, $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2-X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2-X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3-Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3-Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-$ $Z_1-Z_2-Z_3$, $X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2-X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2-X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3-Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3-Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1-Y_2-Y_3-Y_4-Z_1$, $Z_1-X_1-X_2-Y_1-Y_2-Z_1$, $Z_1-X_1-X_2-X_3-Y_1-Y_2-Z_1$, $Z_1-X_1-X_2-X_3-X_4-Y_1-Y_2-Z_1$, $Z_1-X_1-X_2-Y_1-Y_2-Y_3-Z_1$, $Z_1-X_1-X_2-X_3-Y_1-Y_2-Y_3-Z_1$, $Z_1-X_1-X_2-X_3-X_4-Y_1-Y_2-Y_3-Z_1$, $Z_1-X_1-X_2-Y_1-Y_2-Y_3-Y_4-Z_1$, $Z_1-X_1-X_2-X_3-Y_1-Y_2-Y_3-Y_4-Z_1$, $Z_1-X_1-X_2-X_3-X_4-Y_1-Y_2-Y_3-Y_4-Z_1$, $Z_1-Z_2-X_1-X_2-Y_1-Y_2-Z_1$, $Z_1-Z_2-X_1-X_2-X_3-Y_1-Y_2-Z_1$, $Z_1-Z_2-X_1-X_2-X_3-X_4-Y_1-Y_2-Z_1$, $Z_1-Z_2-X_1-X_2-Y_1-Y_2-Y_3-Z_1$, $Z_1-Z_2-X_1-X_2-X_3-Y_1-Y_2-Y_3-Z_1$, $Z_1-Z_2-X_1-X_2-X_3-X_4-Y_1-Y_2-Y_3-Z_1$, $Z_1-Z_2-X_1-X_2-Y_1-Y_2-Y_3-Y_4-Z_1$, $Z_1-Z_2-X_1-X_2-X_3-Y_1-Y_2-Y_3-Y_4-Z_1$, $Z_1-Z_2-X_1-X_2-X_3-X_4-Y_1-Y_2-Y_3-Y_4-Z_1$, $Z_1-Z_2-Z_3-X_1-X_2-Y_1-Y_2-Z_1$, $Z_1-Z_2-Z_3-X_1-X_2-X_3-Y_1-Y_2-Z_1$, $Z_1-Z_2-Z_3-X_1-X_2-X_3-X_4-Y_1-Y_2-Z_1$, $Z_1-Z_2-Z_3-X_1-X_2-Y_1-Y_2-Y_3-Z_1$, $Z_1-Z_2-Z_3-X_1-X_2-X_3-Y_1-Y_2-Y_3-Z_1$, $Z_1-Z_2-Z_3-X_1-X_2-X_3-X_4-Y_1-Y_2-Y_3-Z_1$, $Z_1-Z_2-Z_3-X_1-X_2-Y_1-Y_2-Y_3-Y_4-Z_1$, $Z_1-Z_2-Z_3-X_1-X_2-X_3-Y_1-Y_2-Y_3-Y_4-Z_1$, $Z_1-Z_2-Z_3-X_1-X_2-X_3-X_4-Y_1-Y_2-Y_3-Y_4-Z_1$, $Z_1-Z_2-Z_3-Z_4-X_1-X_2-Y_1-Y_2-Z_1$, $Z_1-Z_2-Z_3-Z_4-X_1-X_2-X_3-Y_1-Y_2-Z_1$, $Z_1-Z_2-Z_3-Z_4-X_1-X_2-X_3-X_4-Y_1-Y_2-Z_1$, $Z_1-Z_2-Z_3-Z_4-X_1-X_2-Y_1-Y_2-Y_3-Z_1$, $Z_1-Z_2-Z_3-Z_4-X_1-X_2-X_3-Y_1-Y_2-Y_3-Z_1$, $Z_1-Z_2-Z_3-Z_4-X_1-X_2-X_3-X_4-Y_1-Y_2-Y_3-Z_1$, $Z_1-Z_2-Z_3-Z_4-X_1-X_2-Y_1-Y_2-Y_3-Y_4-Z_1$, $Z_1-Z_2-Z_3-Z_4-X_1-X_2-X_3-Y_1-Y_2-Y_3-Y_4-Z_1$, $Z_1-Z_2-Z_3-Z_4-X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $Z_1-X_1-X_2-Y_1-Y_2-Z_1-Z_2$, $Z_1-X_1-X_2-X_3-Y_1-Y_2-Z_1-Z_2$, $Z_1-X_1-X_2-X_3-X_4-Y_1-Y_2-Z_1-Z_2$, $Z_1-X_1-X_2-Y_1-Y_2-Y_3-Z_1-Z_2$, $Z_1-X_1-X_2-X_3-Y_1-Y_2-Y_3-Z_1-Z_2$, $Z_1-X_1-X_2-X_3-X_4-Y_1-Y_2-Y_3-Z_1-Z_2$, $Z_1-X_1-X_2-Y_1-Y_2-Y_3-Y_4-Z_1-Z_2$, $Z_1-X_1-X_2-X_3-Y_1-Y_2-Y_3-Y_4-Z_1-Z_2$, $Z_1-X_1-X_2-X_3-X_4-Y_1-Y_2-Y_3-Y_4-Z_1-Z_2$, $Z_1-Z_2-X_1-X_2-Y_1-Y_2-Z_1-Z_2$, $Z_1-Z_2-X_1-X_2-X_3-Y_1-Y_2-Z_1-Z_2$, $Z_1-Z_2-X_1-X_2-X_3-X_4-Y_1-Y_2-Z_1-Z_2$, $Z_1-Z_2-X_1-X_2-Y_1-Y_2-Y_3-Z_1-Z_2$, $Z_1-Z_2-X_1-X_2-X_3-Y_1-Y_2-Y_3-Z_1-Z_2$, $Z_1-Z_2-X_1-X_2-X_3-X_4-Y_1-Y_2-Y_3-Z_1-Z_2$, $Z_1-Z_2-X_1-X_2-Y_1-Y_2-Y_3-Y_4-Z_1-Z_2$, $Z_1-Z_2-X_1-X_2-X_3-Y_1-Y_2-Y_3-Y_4-Z_1-Z_2$, $Z_1-Z_2-X_1-X_2-X_3-X_4-Y_1-Y_2-Y_3-Y_4-Z_1-Z_2$, $Z_1-Z_2-Z_3-X_1-X_2-Y_1-Y_2-Z_1-Z_2$, $Z_1-Z_2-Z_3-X_1-X_2-X_3-Y_1-Y_2-Z_1-Z_2$, $Z_1-Z_2-Z_3-X_1-X_2-X_3-X_4-Y_1-Y_2-Z_1-Z_2$, $Z_1-Z_2-Z_3-X_1-X_2-Y_1-Y_2-Y_3-Z_1-Z_2$, $Z_1-Z_2-Z_3-X_1-X_2-X_3-Y_1-Y_2-Y_3-Z_1-Z_2$, $Z_1-Z_2-Z_3-X_1-X_2-X_3-X_4-Y_1-Y_2-Y_3-Z_1-Z_2$, $Z_1-Z_2-Z_3-X_1-X_2-Y_1-Y_2-Y_3-Y_4-Z_1-Z_2$, $Z_1-Z_2-Z_3-X_1-X_2-X_3-Y_1-Y_2-Y_3-Y_4-Z_1-Z_2$, $Z_1-Z_2-Z_3-X_1-X_2-X_3-X_4-Y_1-Y_2-Y_3-Y_4-Z_1-Z_2$, $Z_1-Z_2-Z_3-Z_4-X_1-X_2-Y_1-Y_2-Z_1-Z_2$, $Z_1-Z_2-Z_3-Z_4-X_1-X_2-X_3-Y_1-Y_2-Z_1-Z_2$, $Z_1-Z_2-Z_3-Z_4-X_1-X_2-X_3-X_4-Y_1-Y_2-Z_1-Z_2$, $Z_1-Z_2-Z_3-Z_4-X_1-X_2-Y_1-Y_2-Y_3-Z_1-Z_2$, $Z_1-Z_2-Z_3-Z_4-X_1-X_2-X_3-Y_1-Y_2-Y_3-Z_1-Z_2$, $Z_1-Z_2-Z_3-Z_4-X_1-X_2-X_3-X_4-Y_1-Y_2-Y_3-Z_1-Z_2$, $Z_1-Z_2-Z_3-Z_4-X_1-X_2-Y_1-Y_2-Y_3-Y_4-Z_1-Z_2$, $Z_1-Z_2-Z_3-Z_4-X_1-X_2-X_3-Y_1-Y_2-Y_3-Y_4-Z_1-Z_2$, $Z_1-Z_2-Z_3-Z_4-X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $Z_1-X_1-X_2-Y_1-Y_2-Z_1-Z_2-Z_3$, $Z_1-X_1-X_2-X_3-Y_1-Y_2-Z_1-Z_2-Z_3$, $Z_1-X_1-X_2-X_3-X_4-Y_1-Y_2-Z_1-Z_2-Z_3$, $Z_1-X_1-X_2-Y_1-Y_2-Y_3-Z_1-Z_2-Z_3$, $Z_1-X_1-X_2-X_3-Y_1-Y_2-Y_3-Z_1-Z_2-Z_3$, $Z_1-X_1-X_2-X_3-X_4-Y_1-Y_2-Y_3-Z_1-Z_2-Z_3$, $Z_1-X_1-X_2-Y_1-Y_2-Y_3-Y_4-Z_1-Z_2-Z_3$, $Z_1-X_1-X_2-X_3-Y_1-Y_2-Y_3-Y_4-Z_1-Z_2-Z_3$, $Z_1-X_1-X_2-X_3-X_4-Y_1-Y_2-Y_3-Y_4-Z_1-Z_2-Z_3$, $Z_1-Z_2-X_1-X_2-Y_1-Y_2-Z_1-Z_2-Z_3$, $Z_1-Z_2-X_1-X_2-X_3-Y_1-Y_2-Z_1-Z_2-Z_3$, $Z_1-Z_2-X_1-X_2-X_3-X_4-Y_1-Y_2-Z_1-Z_2-Z_3$, $Z_1-Z_2-X_1-X_2-Y_1-Y_2-Y_3-Z_1-Z_2-Z_3$, $Z_1-Z_2-X_1-X_2-X_3-Y_1-Y_2-Y_3-Z_1-Z_2-Z_3$, $Z_1-Z_2-X_1-X_2-X_3-X_4-Y_1-Y_2-Y_3-Z_1-Z_2-Z_3$, $Z_1-Z_2-X_1-X_2-Y_1-Y_2-Y_3-Y_4-Z_1-Z_2-Z_3$, $Z_1-Z_2-X_1-X_2-X_3-Y_1-Y_2-Y_3-Y_4-Z_1-Z_2-Z_3$, $Z_1-Z_2-X_1-X_2-X_3-X_4-Y_1-Y_2-Y_3-Y_4-Z_1-Z_2-Z_3$, $Z_1-Z_2-Z_3-X_1-X_2-Y_1-Y_2-Z_1-Z_2-Z_3$, $Z_1-Z_2-Z_3-X_1-X_2-X_3-Y_1-Y_2-Z_1-Z_2-Z_3$, $Z_1-Z_2-Z_3-X_1-X_2-X_3-X_4-Y_1-Y_2-Z_1-Z_2-Z_3$, $Z_1-Z_2-Z_3-X_1-X_2-Y_1-Y_2-Y_3-Z_1-Z_2-Z_3$, $Z_1-Z_2-Z_3-X_1-X_2-X_3-Y_1-Y_2-Y_3-Z_1-Z_2-Z_3$, $Z_1-Z_2-Z_3-X_1-X_2-X_3-X_4-Y_1-Y_2-Y_3-Z_1-Z_2-Z_3$, $Z_1-Z_2-Z_3-X_1-X_2-Y_1-Y_2-Y_3-Y_4-Z_1-Z_2-Z_3$, $Z_1-Z_2-Z_3-X_1-X_2-X_3-Y_1-Y_2-Y_3-Y_4-Z_1-Z_2-Z_3$, $Z_1-Z_2-Z_3-X_1-X_2-X_3-X_4-Y_1-Y_2-Y_3-Y_4-Z_1-Z_2-Z_3$, $Z_1-Z_2-Z_3-Z_4-X_1-X_2-Y_1-Y_2-Z_1-Z_2-Z_3$, $Z_1-Z_2-Z_3-Z_4-X_1-X_2-X_3-Y_1-Y_2-Z_1-Z_2-Z_3$, $Z_1-Z_2-Z_3-Z_4-X_1-X_2-X_3-X_4-Y_1-Y_2-Z_1-Z_2-Z_3$, $Z_1-Z_2-Z_3-Z_4-X_1-X_2-Y_1-Y_2-Y_3-Z_1-Z_2-Z_3$, $Z_1-Z_2-Z_3-Z_4-X_1-X_2-X_3-Y_1-Y_2-Y_3-Z_1-Z_2-Z_3$, $Z_1-Z_2-Z_3-Z_4-X_1-X_2-X_3-X_4-Y_1-Y_2-Y_3-Z_1-Z_2-Z_3$, $Z_1-Z_2-Z_3-Z_4-X_1-X_2-Y_1-Y_2-Y_3-Y_4-Z_1-Z_2-Z_3$, $Z_1-Z_2-Z_3-Z_4-X_1-X_2-X_3-Y_1-Y_2-Y_3-Y_4-Z_1-Z_2-Z_3$, $Z_1-Z_2-Z_3-Z_4-X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Z_1-X_1-X_2-Y_1-Y_2-Z_1-Z_2-Z_3-Z_4$, $Z_1-X_1-X_2-X_3-Y_1-Y_2-Z_1-Z_2-Z_3-Z_4$, $Z_1-X_1-X_2-X_3-X_4-Y_1-Y_2-Z_1-Z_2-Z_3-Z_4$, $Z_1-X_1-X_2-Y_1-Y_2-Y_3-Z_1-Z_2-Z_3-Z_4$, $Z_1-X_1-X_2-X_3-Y_1-Y_2-Y_3-Z_1-Z_2-Z_3-Z_4$, $Z_1-X_1-X_2-X_3-X_4-Y_1-Y_2-Y_3-Z_1-Z_2-Z_3-Z_4$, $Z_1-X_1-X_2-Y_1-Y_2-Y_3-Y_4-Z_1-Z_2-Z_3-Z_4$, $Z_1-X_1-X_2-X_3-Y_1-Y_2-Y_3-Y_4-Z_1-Z_2-Z_3-Z_4$, $Z_1-X_1-X_2-X_3-X_4-Y_1-Y_2-Y_3-Y_4-Z_1-Z_2-Z_3-Z_4$, $Z_1-Z_2-X_1-X_2-Y_1-Y_2-Z_1-Z_2-Z_3-Z_4$, $Z_1-Z_2-X_1-X_2-X_3-Y_1-Y_2-Z_1-Z_2-Z_3-Z_4$, $Z_1-Z_2-X_1-X_2-X_3-X_4-Y_1-Y_2-Z_1-Z_2-Z_3-Z_4$, $Z_1-Z_2-X_1-X_2-Y_1-Y_2-Y_3-Z_1-Z_2-Z_3-Z_4$, $Z_1-Z_2-X_1-X_2-X_3-Y_1-Y_2-Y_3-Z_1-Z_2-Z_3-Z_4$, $Z_1-Z_2-X_1-X_2-X_3-X_4-Y_1-Y_2-Y_3-Z_1-Z_2-Z_3-Z_4$, $Z_1-Z_2-X_1-X_2-Y_1-Y_2-Y_3-Y_4-Z_1-Z_2-Z_3-Z_4$, $Z_1-Z_2-X_1-X_2-X_3-Y_1-Y_2-Y_3-Y_4-Z_1-Z_2-Z_3-Z_4$, $Z_1-Z_2-X_1-X_2-X_3-X_4-Y_1-Y_2-Y_3-Y_4-Z_1-Z_2-Z_3-Z_4$, $Z_1-Z_2-Z_3-X_1-X_2-Y_1-Y_2-Z_1-Z_2-Z_3-Z_4$, $Z_1-Z_2-Z_3-X_1-X_2-X_3-Y_1-Y_2-Z_1-Z_2-Z_3-Z_4$, $Z_1-Z_2-Z_3-X_1-X_2-X_3-X_4-Y_1-Y_2-Z_1-Z_2-Z_3-Z_4$, $Z_1-Z_2-Z_3-X_1-X_2-Y_1-Y_2-Y_3-Z_1-Z_2-Z_3-Z_4$, $Z_1-Z_2-Z_3-X_1-X_2-X_3-Y_1-Y_2-Y_3-Z_1-Z_2-Z_3-Z_4$, $Z_1-Z_2-Z_3-X_1-X_2-X_3-X_4-Y_1-Y_2-Y_3-Z_1-Z_2-Z_3-Z_4$, $Z_1-Z_2-Z_3-X_1-X_2-Y_1-Y_2-Y_3-Y_4-Z_1-Z_2-Z_3-Z_4$, $Z_1-Z_2-Z_3-X_1-X_2-X_3-Y_1-Y_2-Y_3-Y_4-Z_1-Z_2-Z_3-Z_4$, $Z_1-Z_2-Z_3-X_1-X_2-X_3-X_4-Y_1-Y_2-Y_3-Y_4-Z_1-Z_2-Z_3-Z_4$, $Z_1-Z_2-Z_3-Z_4-X_1-X_2-Y_1-Y_2-Z_1-Z_2-Z_3-Z_4$, $Z_1-Z_2-Z_3-Z_4-X_1-X_2-X_3-Y_1-Y_2-Z_1-Z_2-Z_3-Z_4$, $Z_1-Z_2-Z_3-Z_4-X_1-X_2-X_3-X_4-Y_1-Y_2-Z_1-Z_2-Z_3-Z_4$, $Z_1-Z_2-Z_3-Z_4-X_1-X_2-Y_1-Y_2-Y_3-Z_1-Z_2-Z_3-Z_4$, $Z_1-Z_2-Z_3-Z_4-X_1-X_2-X_3-Y_1-Y_2-Y_3-Z_1-Z_2-Z_3-Z_4$, $Z_1-Z_2-Z_3-Z_4-X_1-X_2-X_3-X_4-Y_1-Y_2-Y_3-Z_1-Z_2-Z_3-Z_4$, $Z_1-Z_2-Z_3-Z_4-X_1-X_2-Y_1-Y_2-Y_3-Y_4-Z_1-Z_2-Z_3-Z_4$, $Z_1-Z_2-Z_3-Z_4-X_1-X_2-X_3-Y_1-Y_2-Y_3-Y_4-Z_1-Z_2-Z_3-Z_4$, $Z_1-Z_2-Z_3-Z_4-X_1-X_2-X_3-X_4-Y_1-Y_2-Y_3-Y_4-Z_1-Z_2-Z_3-Z_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Z_1-Y_1-Y_2-X_1-X_2-Z_1$, $Z_1-Y_1-Y_2-X_1-X_2-X_3-Z_1$, $Z_1-Y_1-Y_2-X_1-X_2-X_3-X_4-Z_1$, $Z_1-Y_1-Y_2-Y_3-X_1-X_2-Z_1$, $Z_1-Y_1-Y_2-Y_3-X_1-X_2-X_3-Z_1$, $Z_1-Y_1-Y_2-Y_3-X_1-X_2-X_3-X_4-Z_1$, $Z_1-Y_1-Y_2-Y_3-Y_4-X_1-X_2-Z_1$, $Z_1-Y_1-Y_2-Y_3-Y_4-X_1-X_2-X_3-Z_1$, $Z_1-Y_1-Y_2-Y_3-Y_4-X_1-X_2-X_3-X_4-Z_1$, $Z_1-Z_2-Y_1-Y_2-X_1-X_2-Z_1$, $Z_1-Z_2-Y_1-Y_2-X_1-X_2-X_3-Z_1$, $Z_1-Z_2-Y_1-Y_2-X_1-X_2-X_3-X_4-Z_1$, $Z_1-Z_2-Y_1-Y_2-Y_3-X_1-X_2-Z_1$, $Z_1-Z_2-Y_1-Y_2-Y_3-X_1-X_2-X_3-Z_1$, $Z_1-Z_2-Y_1-Y_2-Y_3-X_1-X_2-X_3-X_4-Z_1$, $Z_1-Z_2-Y_1-Y_2-Y_3-Y_4-X_1-X_2-Z_1$, $Z_1-Z_2-Y_1-Y_2-Y_3-Y_4-X_1-X_2-X_3-Z_1$, $Z_1-Z_2-Y_1-Y_2-Y_3-Y_4-X_1-X_2-X_3-X_4-Z_1$, $Z_1-Z_2-Z_3-Y_1-Y_2-X_1-X_2-Z_1$, $Z_1-Z_2-Z_3-Y_1-Y_2-X_1-X_2-X_3-Z_1$, $Z_1-Z_2-Z_3-Y_1-Y_2-X_1-X_2-X_3-X_4-Z_1$, $Z_1-Z_2-Z_3-Y_1-Y_2-Y_3-X_1-X_2-Z_1$, $Z_1-Z_2-Z_3-Y_1-Y_2-Y_3-X_1-X_2-X_3-Z_1$, $Z_1-Z_2-Z_3-Y_1-Y_2-Y_3-X_1-X_2-X_3-X_4-Z_1$, $Z_1-Z_2-Z_3-Y_1-Y_2-Y_3-Y_4-X_1-X_2-Z_1$, $Z_1-Z_2-Z_3-Y_1-Y_2-Y_3-Y_4-X_1-X_2-X_3-Z_1$, $Z_1-Z_2-Z_3-Y_1-Y_2-Y_3-Y_4-X_1-X_2-X_3-X_4-Z_1$, $Z_1-Z_2-Z_3-Z_4-Y_1-Y_2-X_1-X_2-Z_1$, $Z_1-Z_2-Z_3-Z_4-Y_1-Y_2-X_1-X_2-X_3-Z_1$, $Z_1-Z_2-Z_3-Z_4-Y_1-Y_2-X_1-X_2-X_3-X_4-Z_1$, $Z_1-Z_2-Z_3-Z_4-Y_1-Y_2-Y_3-X_1-X_2-Z_1$, $Z_1-Z_2-Z_3-Z_4-Y_1-Y_2-Y_3-X_1-X_2-X_3-Z_1$, $Z_1-Z_2-Z_3-Z_4-Y_1-Y_2-Y_3-X_1-X_2-X_3-X_4-Z_1$, $Z_1-Z_2-Z_3-Z_4-Y_1-Y_2-Y_3-Y_4-X_1-X_2-Z_1$, $Z_1-Z_2-Z_3-Z_4-Y_1-Y_2-$ $Y_3-Y_4-X_1-X_2-X_3-Z_1$, $Z_1-Z_2-Z_3-Z_4-Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Z_1-Y_1-Y_2-X_1-X_2-Z_1-Z_2$, $Z_1-Y_1-Y_2-X_1-X_2-X_3-Z_1-Z_2$, $Z_1-Y_1-Y_2-X_1-X_2-X_3-X_4-Z_1-Z_2$, $Z_1-Y_1-Y_2-Y_3-X_1-X_2-Z_1-Z_2$, $Z_1-Y_1-Y_2-Y_3-X_1-X_2-X_3-Z_1-Z_2$, $Z_1-Y_1-Y_2-Y_3-X_1-X_2-X_3-X_4-Z_1-Z_2$, $Z_1-Y_1-Y_2-Y_3-Y_4-X_1-X_2-Z_1-Z_2$, $Z_1-Y_1-Y_2-Y_3-Y_4-X_1-X_2-X_3-Z_1-Z_2$, $Z_1-Y_1-Y_2-Y_3-Y_4-X_1-X_2-X_3-X_4-Z_1-Z_2$, $Z_1-Z_2-Y_1-Y_2-X_1-X_2-Z_1-Z_2$, $Z_1-Z_2-Y_1-Y_2-X_1-X_2-X_3-Z_1-Z_2$, $Z_1-Z_2-Y_1-Y_2-X_1-X_2-X_3-X_4-Z_1-Z_2$, $Z_1-Z_2-Y_1-Y_2-Y_3-X_1-X_2-Z_1-Z_2$, $Z_1-Z_2-Y_1-Y_2-Y_3-X_1-X_2-X_3-Z_1-Z_2$, $Z_1-Z_2-Y_1-Y_2-Y_3-X_1-X_2-X_3-X_4-Z_1-Z_2$, $Z_1-Z_2-Y_1-Y_2-Y_3-Y_4-X_1-X_2-Z_1-Z_2$, $Z_1-Z_2-Y_1-Y_2-Y_3-Y_4-X_1-X_2-X_3-Z_1-Z_2$, $Z_1-Z_2-Y_1-Y_2-Y_3-Y_4-X_1-X_2-X_3-X_4-Z_1-Z_2$, $Z_1-Z_2-Z_3-Y_1-Y_2-X_1-X_2-Z_1-Z_2$, $Z_1-Z_2-Z_3-Y_1-Y_2-X_1-X_2-X_3-Z_1-Z_2$, $Z_1-Z_2-Z_3-Y_1-Y_2-X_1-X_2-X_3-X_4-Z_1-Z_2$, $Z_1-Z_2-Z_3-Y_1-Y_2-Y_3-X_1-X_2-Z_1-Z_2$, $Z_1-Z_2-Z_3-Y_1-Y_2-Y_3-X_1-X_2-X_3-Z_1-Z_2$, $Z_1-Z_2-Z_3-Y_1-Y_2-Y_3-X_1-X_2-X_3-X_4-Z_1-Z_2$, $Z_1-Z_2-Z_3-Y_1-Y_2-Y_3-Y_4-X_1-X_2-Z_1-Z_2$, $Z_1-Z_2-Z_3-Y_1-Y_2-Y_3-Y_4-X_1-X_2-X_3-Z_1-Z_2$, $Z_1-Z_2-Z_3-Y_1-Y_2-Y_3-Y_4-X_1-X_2-X_3-X_4-Z_1-Z_2$, $Z_1-Z_2-Z_3-Z_4-Y_1-Y_2-X_1-X_2-Z_1-Z_2$, $Z_1-Z_2-Z_3-Z_4-Y_1-Y_2-X_1-X_2-X_3-Z_1-Z_2$, $Z_1-Z_2-Z_3-Z_4-Y_1-Y_2-X_1-X_2-X_3-X_4-Z_1-Z_2$, $Z_1-Z_2-Z_3-Z_4-Y_1-Y_2-Y_3-X_1-X_2-Z_1-Z_2$, $Z_1-Z_2-Z_3-Z_4-Y_1-Y_2-Y_3-X_1-X_2-X_3-Z_1-Z_2$, $Z_1-Z_2-Z_3-Z_4-Y_1-Y_2-Y_3-X_1-X_2-X_3-X_4-Z_1-Z_2$, $Z_1-Z_2-Z_3-Z_4-Y_1-Y_2-Y_3-Y_4-X_1-X_2-Z_1-Z_2$, $Z_1-Z_2-Z_3-Z_4-Y_1-Y_2-Y_3-Y_4-X_1-X_2-X_3-Z_1-Z_2$, $Z_1-Z_2-Z_3-Z_4-Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Z_1-Y_1-Y_2-X_1-X_2-Z_1-Z_2-Z_3$, $Z_1-Y_1-Y_2-X_1-X_2-X_3-Z_1-Z_2-Z_3$, $Z_1-Y_1-Y_2-X_1-X_2-X_3-X_4-Z_1-Z_2-Z_3$, $Z_1-Y_1-Y_2-Y_3-X_1-X_2-Z_1-Z_2-Z_3$, $Z_1-Y_1-Y_2-Y_3-X_1-X_2-X_3-Z_1-Z_2-Z_3$, $Z_1-Y_1-Y_2-Y_3-X_1-X_2-X_3-X_4-Z_1-Z_2-Z_3$, $Z_1-Y_1-Y_2-Y_3-Y_4-X_1-X_2-Z_1-Z_2-Z_3$, $Z_1-Y_1-Y_2-Y_3-Y_4-X_1-X_2-X_3-Z_1-Z_2-Z_3$, $Z_1-Y_1-Y_2-Y_3-Y_4-X_1-X_2-X_3-X_4-Z_1-Z_2-Z_3$, $Z_1-Z_2-Y_1-Y_2-X_1-X_2-Z_1-Z_2-Z_3$, $Z_1-Z_2-Y_1-Y_2-X_1-X_2-X_3-Z_1-Z_2-Z_3$, $Z_1-Z_2-Y_1-Y_2-X_1-X_2-X_3-X_4-Z_1-Z_2-Z_3$, $Z_1-Z_2-Y_1-Y_2-Y_3-X_1-X_2-Z_1-Z_2-Z_3$, $Z_1-Z_2-Y_1-Y_2-Y_3-X_1-X_2-X_3-Z_1-Z_2-Z_3$, $Z_1-Z_2-Y_1-Y_2-Y_3-X_1-X_2-X_3-X_4-Z_1-Z_2-Z_3$, $Z_1-Z_2-Y_1-Y_2-Y_3-Y_4-X_1-X_2-Z_1-Z_2-Z_3$, $Z_1-Z_2-Y_1-Y_2-Y_3-Y_4-X_1-X_2-X_3-Z_1-Z_2-Z_3$, $Z_1-Z_2-Y_1-Y_2-Y_3-Y_4-X_1-X_2-X_3-X_4-Z_1-Z_2-Z_3$, $Z_1-Z_2-Z_3-Y_1-Y_2-X_1-X_2-Z_1-Z_2-Z_3$, $Z_1-Z_2-Z_3-Y_1-Y_2-X_1-X_2-X_3-Z_1-Z_2-Z_3$, $Z_1-Z_2-Z_3-Y_1-Y_2-X_1-X_2-X_3-X_4-Z_1-Z_2-Z_3$, $Z_1-Z_2-Z_3-Y_1-Y_2-Y_3-X_1-X_2-Z_1-Z_2-Z_3$, $Z_1-Z_2-Z_3-Y_1-Y_2-Y_3-X_1-X_2-X_3-Z_1-Z_2-Z_3$, $Z_1-Z_2-Z_3-Y_1-Y_2-Y_3-X_1-X_2-X_3-X_4-Z_1-Z_2-Z_3$, $Z_1-Z_2-Z_3-Y_1-Y_2-Y_3-Y_4-X_1-X_2-Z_1-Z_2-Z_3$, $Z_1-Z_2-Z_3-Y_1-Y_2-Y_3-Y_4-X_1-X_2-X_3-Z_1-Z_2-Z_3$, $Z_1-Z_2-Z_3-Y_1-Y_2-Y_3-Y_4-X_1-X_2-X_3-X_4-Z_1-Z_2-Z_3$, $Z_1-Z_2-Z_3-Z_4-Y_1-Y_2-X_1-X_2-Z_1-Z_2-Z_3$, $Z_1-Z_2-Z_3-Z_4-Y_1-Y_2-X_1-X_2-X_3-Z_1-Z_2-Z_3$, $Z_1-Z_2-Z_3-Z_4-Y_1-Y_2-X_1-X_2-X_3-X_4-Z_1-Z_2-Z_3$, $Z_1-Z_2-Z_3-Z_4-Y_1-Y_2-Y_3-X_1-X_2-Z_1-Z_2-Z_3$, $Z_1-Z_2-Z_3-Z_4-Y_1-Y_2-Y_3-X_1-X_2-X_3-Z_1-Z_2-Z_3$, $Z_1-Z_2-Z_3-Z_4-Y_1-Y_2-Y_3-X_1-X_2-X_3-X_4-Z_1-Z_2-Z_3$, $Z_1-Z_2-Z_3-Z_4-Y_1-Y_2-Y_3-Y_4-X_1-X_2-Z_1-Z_2-Z_3$, $Z_1-Z_2-Z_3-Z_4-Y_1-Y_2-Y_3-Y_4-X_1-X_2-X_3-Z_1-Z_2-Z_3$, $Z_1-Z_2-Z_3-Z_4-Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-Y_1-Y_2-X_1-X_2-Z_1-Z_2-Z_3-Z_4$, $Z_1-Y_1-Y_2-X_1-X_2-X_3-Z_1-Z_2-Z_3-Z_4$, $Z_1-Y_1-Y_2-X_1-X_2-X_3-X_4-Z_1-Z_2-Z_3-Z_4$, $Z_1-Y_1-Y_2-Y_3-X_1-X_2-Z_1-Z_2-Z_3-Z_4$, $Z_1-Y_1-Y_2-Y_3-X_1-X_2-X_3-Z_1-Z_2-Z_3-Z_4$, $Z_1-Y_1-Y_2-Y_3-X_1-X_2-X_3-X_4-Z_1-Z_2-Z_3-Z_4$, $Z_1-Y_1-Y_2-Y_3-Y_4-X_1-X_2-Z_1-Z_2-Z_3-Z_4$, $Z_1-Y_1-Y_2-Y_3-Y_4-X_1-X_2-X_3-Z_1-Z_2-Z_3-Z_4$, $Z_1-Y_1-Y_2-Y_3-Y_4-X_1-X_2-X_3-X_4-Z_1-Z_2-Z_3-Z_4$, $Z_1-Z_2-Y_1-Y_2-X_1-X_2-Z_1-Z_2-Z_3-Z_4$, $Z_1-Z_2-Y_1-Y_2-X_1-X_2-X_3-Z_1-Z_2-Z_3-Z_4$, $Z_1-Z_2-Y_1-Y_2-X_1-X_2-X_3-X_4-Z_1-Z_2-Z_3-Z_4$, $Z_1-Z_2-Y_1-Y_2-Y_3-X_1-X_2-Z_1-Z_2-Z_3-Z_4$, $Z_1-Z_2-Y_1-Y_2-Y_3-X_1-X_2-X_3-Z_1-Z_2-Z_3-Z_4$, $Z_1-Z_2-Y_1-Y_2-Y_3-X_1-X_2-X_3-X_4-Z_1-Z_2-Z_3-Z_4$, $Z_1-Z_2-Y_1-Y_2-Y_3-Y_4-X_1-X_2-Z_1-Z_2-Z_3-Z_4$, $Z_1-Z_2-Y_1-Y_2-Y_3-Y_4-X_1-X_2-X_3-Z_1-Z_2-Z_3-Z_4$, $Z_1-Z_2-Y_1-Y_2-Y_3-Y_4-X_1-X_2-X_3-X_4-Z_1-Z_2-Z_3-Z_4$, $Z_1-Z_2-Z_3-Y_1-Y_2-X_1-X_2-Z_1-Z_2-Z_3-Z_4$, $Z_1-Z_2-Z_3-Y_1-Y_2-X_1-X_2-X_3-Z_1-Z_2-Z_3-Z_4$, $Z_1-Z_2-Z_3-Y_1-Y_2-X_1-X_2-X_3-X_4-Z_1-Z_2-Z_3-Z_4$, $Z_1-Z_2-Z_3-Y_1-Y_2-Y_3-X_1-X_2-Z_1-Z_2-Z_3-Z_4$, $Z_1-Z_2-Z_3-Y_1-Y_2-Y_3-X_1-X_2-X_3-Z_1-Z_2-Z_3-Z_4$, $Z_1-Z_2-Z_3-Y_1-Y_2-Y_3-X_1-X_2-X_3-X_4-Z_1-Z_2-Z_3-Z_4$, $Z_1-Z_2-Z_3-Y_1-Y_2-Y_3-Y_4-X_1-X_2-Z_1-Z_2-Z_3-Z_4$, $Z_1-Z_2-Z_3-Y_1-Y_2-Y_3-Y_4-X_1-X_2-X_3-Z_1-Z_2-Z_3-Z_4$, $Z_1-Z_2-Z_3-Y_1-Y_2-Y_3-Y_4-X_1-X_2-X_3-X_4-Z_1-Z_2-Z_3-Z_4$, $Z_1-Z_2-Z_3-Z_4-Y_1-Y_2-X_1-X_2-Z_1-Z_2-Z_3-Z_4$, $Z_1-Z_2-Z_3-Z_4-Y_1-Y_2-X_1-X_2-X_3-Z_1-Z_2-Z_3-Z_4$, $Z_1-Z_2-Z_3-Z_4-Y_1-Y_2-X_1-X_2-X_3-X_4-Z_1-Z_2-Z_3-Z_4$, $Z_1-Z_2-Z_3-Z_4-Y_1-Y_2-Y_3-X_1-X_2-Z_1-Z_2-Z_3-Z_4$, $Z_1-Z_2-Z_3-Z_4-Y_1-Y_2-Y_3-X_1-X_2-X_3-Z_1-Z_2-Z_3-Z_4$, $Z_1-Z_2-Z_3-Z_4-Y_1-Y_2-Y_3-X_1-X_2-X_3-X_4-Z_1-Z_2-Z_3-Z_4$, $Z_1-Z_2-Z_3-Z_4-Y_1-Y_2-Y_3-Y_4-X_1-X_2-Z_1-Z_2-Z_3-Z_4$, $Z_1-Z_2-Z_3-Z_4-Y_1-Y_2-Y_3-Y_4-X_1-X_2-X_3-Z_1-Z_2-Z_3-Z_4$, $Z_1-Z_2-Z_3-Z_4-Y_1-Y_2-Y_3-Y_4-X_1-X_2-X_3-X_4-Z_1-Z_2-Z_3-Z_4$, wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V. Specific exemplary tertiary peptides selected from the above groups of tertiary peptides are provided below.

In some illustrative embodiments, the binary peptide can contain at least 4 amino acids and up to a maximum of 8 amino acids, whereas the tertiary peptide can contain at least 5 amino acids up to a maximum of 16 amino acids.

In related embodiments, cleavable binary linker peptides (L) comprising an X region and a Y region are described above, and exemplary Z regions (1-4 amino acid sequences, for example, 2 amino acid sequences) that may be fused in frame to the X and/or Y regions (either to the N-terminal sequence of an X or Y region, or the C-terminal sequence of an X or Y region) described above form the tertiary cleavable linking peptides. Illustrative Z or spacer amino acid sequences may include: AA, AF, AM, AN, AQ, AV, AW, AY, DA, DD, DE, DF, DG, DI, DL, DP, DS, DT, DV, DW, DY, EA, ED, EE, EF, EG, EI, EL, EP, ES, ET, EV, EW, EY, FA, FD, FE, FF, FI, FK, FL, FM, FN, FQ, FR, FS, FT, FV, FW, FY, GA, GD, GE, GF, GI, GL, GM, GN, GQ, GS, GV, GW, GY, HA, HD, HE, HF, HH, HI, HK, HL, FIN, HP, HQ, HR, HS, HT, HV, HY, IA, ID, IE, IG, IH, II, IK, IL, IM, IN, IP, IQ, IR, IS, IT, IV, IW, KA, KD, KE, KF, KI, KL, KN, KQ, KV, KY, LA, LD, LE, LG, LH, LI, LK, LL, LM, LN, LP, LQ, LR, LS, LT, LV, LW, MA, MF, MG, MI, MK, ML, MM, MN, MQ, MR, MS, MT, MV, MY, NA, ND, NE, NF, NI, NL, NM, NN, NQ, NS, NT, NV, NY, QA, QD, QE, QF, QI, QL, QM, QN, QQ, QS, QT, QV, QY, RA, RD, RE, RF, RI, RL, RN, RQ, RV, RY, SA, SF, SG, SK, SN, SP, SQ, SR, SS, ST, SV, SW, SY, TA, TF, TG, TK, TN, TP, TQ, TR, TS, TT, TV, TW, TY, VA, VF, VM, VN, VQ, VV, VW, VY, WA, WF, WI, WK, WL, WN, WP, WQ, WR, WS, WT, WV, WW, WY, YA, YD, YE, YF, YI, YK, YL, YM, YN, YQ, YR, YS, YT, YV, YW, or YY. In exemplary embodiments, individual tertiary peptides of the present invention can include a two amino acid sequence, fused in frame to the N-terminus and/or the C-terminus of an illustrative binary peptide disclosed above, wherein the two amino acid sequence is AM, LH, MN, ES, WQ, or DT.

In exemplary embodiments, individual tertiary peptides of the present invention can include a two amino acid sequence, fused in frame to the N-terminus and/or the C-terminus of an illustrative binary peptide disclosed above, wherein the two amino acid sequence is GS, WN, WQ, MA or MV.

In some embodiments, the spacer portion of the tertiary peptide (Z region) comprises the amino acid sequence GS, which may be fused in frame to the N-terminus or C-terminus of the binary peptide or both.

In various embodiments, exemplary binary peptides for use in the insecticidal and/or nematicidal polypeptides and proteins, DNA constructs and incorporated into transgenic plants or parts thereof, of the present invention may include one or more cleavable tertiary peptides comprising, or selected from the group of, or consisting of: a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini with a Z region or spacer sequence, comprising, or selected from the group of, or consisting of: GS, WN, WQ, MA, MV, AM, LH, MN, ES, WQ, or DT.

In some embodiments, exemplary tertiary linking peptides (L) for use in the insecticidal and/or nematicidal polypeptides and proteins, DNA constructs and incorporated into transgenic plants or parts thereof, of the present invention may include (ZXY or XYZ) comprising the following amino acid sequences: AFVRLFGS (SEQ ID NO: 1649), AKLFVGS (SEQ ID NO: 1650), ALFALKGS (SEQ ID NO: 1651), ALFLKGS (SEQ ID NO: 1652), ALFLRGS (SEQ ID NO: 1653), ALFRGS (SEQ ID NO: 1654), ALFRLRGS (SEQ ID NO: 1655), ALKALFGS (SEQ ID NO: 1656), ALKFFGS (SEQ ID NO: 1657), ALKFLVGS (SEQ ID NO: 1658), ALKIFVGS (SEQ ID NO: 1659), ALKLFVGS (SEQ ID NO: 1660), FFADIKGS (SEQ ID NO: 1661), FFALKGS (SEQ ID NO: 1662), FFLKGS (SEQ ID NO: 1663), FFLRGS (SEQ ID NO: 1664), FFRLRGS (SEQ ID NO: 1665), FGYRIKGS (SEQ ID NO: 1666), FLRLFGS (SEQ ID NO: 1667), FYARRGS (SEQ ID NO: 1668), GGLRKKGS (SEQ ID NO: 1669), IFVALKGS (SEQ ID NO: 1670), IFVLKGS (SEQ ID NO: 1671), IFVLRGS (SEQ ID NO: 1672), IFVRGS (SEQ ID NO: 1673), IFVRLRGS (SEQ ID NO: 1674), ILFNIKGS (SEQ ID NO: 1675), LFAAPFGS (SEQ ID NO: 1676), LFVALKGS (SEQ ID NO: 1677), LFVLKGS (SEQ ID NO: 1678), LFVLRGS (SEQ ID NO: 1679), LFVRGS (SEQ ID NO: 1680), LFVRLRGS (SEQ ID NO: 1681), LFVRVFLGS (SEQ ID NO: 1682), LGERGS (SEQ ID NO: 1683), LKALFGS (SEQ ID NO: 1684), LKFFGS (SEQ ID NO: 1685), LKIFVGS (SEQ ID NO: 1686), LKLFVGS (SEQ ID NO: 1687), LRALFGS (SEQ ID NO: 1688), LRFFGS (SEQ ID NO: 1689), LRIFVGS (SEQ ID NO: 1690), LRLFVGS (SEQ ID NO: 1691), RALFGS (SEQ ID NO: 1692), RIFVGS (SEQ ID NO: 1693), RLFVGS (SEQ ID NO: 1694), RLRALFGS (SEQ ID NO: 1695), RLRFFGS (SEQ ID NO: 1696), RLRIFVGS (SEQ ID NO: 1697), RLRLFVGS (SEQ ID NO: 1698), RRKAFVGS (SEQ ID NO: 1699), RRKLIFGS (SEQ ID NO: 1700), RRRFFAGS (SEQ ID NO: 1701), VFGRKGGS (SEQ ID NO: 1702), YFVRKGS (SEQ ID NO: 1703), GSAFVRLF (SEQ ID NO: 1704), GSAKLFV (SEQ ID NO: 1705), GSALFALK (SEQ ID NO: 1706), GSALFLK (SEQ ID NO: 1707), GSALFLR (SEQ ID NO: 1708), GSALFR (SEQ ID NO: 1709), GSALFRLR (SEQ ID NO: 1710), GSALKALF (SEQ ID NO: 1711), GSALKFF (SEQ ID NO: 1712), GSALKFLV (SEQ ID NO: 1713), GSALKIFV (SEQ ID NO: 1714), GSALKLFV (SEQ ID NO: 1715), GSFFADIK (SEQ ID NO: 1716), GSFFALK (SEQ ID NO: 1717), GSFFLK (SEQ ID NO: 1718), GSFFLR (SEQ ID NO: 1719), GSFFRLR (SEQ ID NO: 1720), GSFGYRIK (SEQ ID NO: 1721), GSFLRLF (SEQ ID NO: 1722), GSFYARR (SEQ ID NO: 1723), GSGGLRKK (SEQ ID NO: 1724), GSIFVALK (SEQ ID NO: 1725), GSIFVLK (SEQ ID NO: 1726), GSIFVLR (SEQ ID NO: 1727), GSIFVR (SEQ ID NO: 1728), GSIFVRLR (SEQ ID NO: 1729), GSILFNIK (SEQ ID NO: 1730), GSLFAAPF (SEQ ID NO: 1731), GSLFVALK (SEQ ID NO: 1732), GSLFVLK (SEQ ID NO: 1733), GSLFVLR (SEQ ID NO: 1734), GSLFVR (SEQ ID NO: 1735), GSLFVRLR (SEQ ID NO: 1736), GSLFVRVFL (SEQ ID NO: 1737), GSLGER (SEQ ID NO: 1738), GSLKALF (SEQ ID NO: 1739), GSLKFF (SEQ ID NO: 1740), GSLKIFV (SEQ ID NO: 1741), GSLKLFV (SEQ ID NO: 1742), GSLRALF (SEQ ID NO: 1743), GSLRFF (SEQ ID NO: 1744), GSLRIFV (SEQ ID NO: 1745), GSLRLFV (SEQ ID NO: 1746), GSRALF (SEQ ID NO: 1747), GSRIFV (SEQ ID NO: 1748), GSRLFV (SEQ ID NO: 1749), GSRLRALF (SEQ ID NO: 1750), GSRLRFF (SEQ ID NO: 1751), GSRLRIFV (SEQ ID NO: 1752), GSRLRLFV (SEQ ID NO: 1753), GSRRKAFV (SEQ ID NO: 1754), GSRRKLIF (SEQ ID NO: 1755), GSRRRFFA (SEQ ID NO: 1756), GSVFGRKG (SEQ ID NO: 1757), and GSYFVRK (SEQ ID NO: 1758).

In various embodiments, a representative binary peptide of the present invention can include: IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621).

(1D). Insecticidal and/or Nematicidal Proteins

In various embodiments of the present invention, the present disclosure provides an insecticidal and/or nematicidal protein having a cleavable peptide (L) (a binary or a tertiary peptide) as described above fused in frame with an insecticidal or nematicidal toxic protein (TP). In another embodiment, the present invention provides an insecticidal and/or nematicidal protein having two or more cleavable peptides, wherein the insecticidal and/or nematicidal protein comprises a binary or tertiary peptide, the binary or tertiary peptide is fused in frame with a construct comprising, consisting essentially of, or consisting of: $(L\text{-}TP)_n$, or $(L\text{-}TP)_n\text{-}L$, or $(TP\text{-}L)_n$, or $L\text{-}(TP\text{-}L)_n$, wherein TP is a toxic peptide or protein, L is a binary or tertiary cleavable peptide, and n is an integer ranging from 1 to 200, or from 1 to 100, or from 1 to 10. In another embodiment, the insecticidal and/or nematicidal protein described herein comprises an endoplasmic reticulum signal peptide (ERSP) fused in frame with: a binary peptide or tertiary peptide, which is fused in frame with an insecticidal and/or nematicidal toxic protein and/or a repeat construct $(L\text{-}TP)_n$, or $(TP\text{-}L)_n$, wherein n is an integer ranging from 1 to 200, or from 1 to 100, or from 1 to 10. In various embodiments, an exemplary insecticidal and/or nematicidal protein can include a protein construct comprising: $(ERSP)\text{-}(TP\text{-}L)_n$, or $(ERSP)\text{-}(L)\text{-}(TP\text{-}L)_n$, or $(ERSP)\text{-}(L\text{-}TP)_n$, or $(ERSP)\text{-}(L\text{-}TP)_n\text{-}(L)$, wherein n is an integer ranging from 1 to 200. In various related embodiments described above, TP is a toxic protein, L is a binary or tertiary peptide and n is an integer ranging from 1 to 200, preferably an integer ranging from 1 to 100, and more preferably an integer ranging from 1 to 10. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide. In some embodiments, the N-terminal TP is fused or unfused at its N-terminus with a binary or tertiary peptide.

In another embodiment, the present invention provides an insecticidal and/or nematicidal protein having two or more cleavable peptides, wherein the insecticidal and/or nematicidal protein comprises a stabilizing domain (STA) fused in frame with either the N-terminus of a binary or tertiary peptide, or the N-terminus of a construct comprising: $(L\text{-}TP)_n$, $(L\text{-}TP)_n$-L, $(TP\text{-}L)_n$, or L-$(TP\text{-}L)_n$. In some related embodiments, an insecticidal and/or nematicidal protein comprises an ERSP fused in frame with the N-terminus of a stabilizing domain (STA), which is fused in frame with either the N-terminus of a binary or tertiary peptide, being fused to the N-terminus of a toxic protein, or the N-terminus of a construct comprising: $(L\text{-}TP)_n$, $(L\text{-}TP)_n$-L, $(TP\text{-}L)_n$, or L-$(TP\text{-}L)_n$. In various embodiments, an exemplary insecticidal and/or nematicidal protein can include a construct comprising: (ERSP)-(STA)-$(L\text{-}TP)_n$, or (ERSP)-(STA)-$(L\text{-}TP)_n$-(L), or (ERSP)-(STA)-$(TP\text{-}L)_n$, or (ERSP)-(STA)-(L)-$(TP\text{-}L)_n$, or (STA)-$(L\text{-}TP)_n$, or (STA)-$(L\text{-}TP)_n$-(L), or (STA)-$(TP\text{-}L)_n$, or (STA)-(L)-$(TP\text{-}L)_n$. In some related embodiments, an insecticidal and/or nematicidal protein comprises an ERSP fused in frame with either the N-terminus of a binary or tertiary peptide, being fused to the N-terminus of a toxic protein, or the N-terminus of a construct comprising: $(L\text{-}TP)_n$, $(L\text{-}TP)_n$-L, $(TP\text{-}L)_n$, or L-$(TP\text{-}L)_n$. In various embodiments, an exemplary insecticidal and/or nematicidal protein can include a construct comprising: (ERSP)-$(L\text{-}TP)_n$, or (ERSP)-$(L\text{-}TP)_n$-(L), or (ERSP)-$(TP\text{-}L)_n$, or (ERSP)-(L)-$(TP\text{-}L)_n$. In various embodiments as described herein and above, TP is defined as a toxic protein, that is toxic to an insect and/or a nematode, L is a binary or tertiary peptide and n is an integer ranging from 1 to 200, preferably an integer ranging from 1 to 100, and more preferably an integer ranging from 1 to 10. In some embodiments, the C-terminal TP of a construct described herein and above is fused or unfused at its C-terminus with a binary or tertiary peptide. In some embodiments, the N-terminal TP is fused or unfused at its N-terminus with a binary or tertiary peptide. In some of the above embodiments, the TP used in the insecticidal and/or nematicidal protein can be a peptide or protein having an amino acid sequence as set forth in SEQ ID NOs 5-1593 and 1761-1775, or a variant thereof. In various embodiments, the TP may be the same or different, and the linker (L) may be the same or different. In some related embodiments, TPs useful in the various insecticidal and/or nematicidal proteins, polynucleotides and DNA constructs encoding these insecticidal and/or nematicidal proteins, and transgenic plants or plant cells containing these insecticidal and/or nematicidal proteins, include peptides having at least 80%, at least 85%, at least 90%, at least 95%, at least 96%, at least 97%, at least 98%, at least 99%, or at least 100% sequence identity or sequence homology to a peptide having an amino acid sequence as set forth in SEQ ID NOs: 5, 6 and 1761, 1762, 1767, 1771-1773, and variants thereof.

(2). Endoplasmic Reticulum Signal Peptide (ERSP)

In various embodiments, the binary and/or tertiary cleavable linking peptides may be linked, or fused, or coupled (i.e., connected in frame, and used interchangeably herein) with one or more additional components. In some embodiments, the binary and/or tertiary cleavable linking peptides are linked to an endoplasmic reticulum signal peptide (ERSP) as further described herein. In various embodiments, the N-terminus of an illustrative binary and/or tertiary cleavable linking peptide is linked to the C-terminus of the ERSP.

As used herein, an ERSP refers to a short continuous stretch of amino acids residues at the amino-terminus of secreted and membrane-bound proteins. The signal peptide targets the protein to the secretory pathway and is cleaved from the nascent chain once translocated in the endoplasmatic reticulum membrane. The signal peptide consists of three regions: an amino-terminal polar region (N region), where frequently positive charged amino acid residues are observed, a central hydrophobic region (H region) of 7-8 amino acid residues and a carboxy-terminal region (C region) that includes the cleavage site. The cleavage of the signal peptide from the mature protein or polypeptide occurs at this cleavage site. An exemplary ERSP is between 3 to 100 amino acids in length, or between 5 to 50 amino acids in length, or between 20 to 30 amino acids in length. The ERSP is a signal peptide so called because it directs the transportation of a protein. Signal peptides may also be called targeting signals, signal sequences, transit peptides, or localization signals. The signal peptides for ER trafficking are often 15 to 30 amino acid residues in length and have a tripartite organization, comprised of a core of hydrophobic residues flanked by a positively charged amino terminal and a polar, but uncharged carboxy terminal region. (Zimmermann, et al., "Protein translocation across the ER membrane", Biochimica et Biohysica Acta, 2011, 1808: 912-924).

Many ERSPs are known. Many plant ERSPs are known. In various embodiments, illustrative ERSPs include the ERSP be derived from a plant ERSP. In some embodiments, illustrative ERSPs also include non-plant ERSPs, which are operable with the procedures described herein. Many plant ERSPs are however well known and certain exemplified plant derived ERSPs are useful in the present invention. As used herein, "plant ERSPs" include naturally occurring ERSPs from plant origin. They do not include non-plant originated ERSPs that have been transfected into plants or plant cells and expressed in plants. In one illustrative embodiment, a plant ERSP includes the barley alpha-amylase signal peptide (BAAS), for example, is derived from the plant, *Hordeum vulgare*, and has the amino acid sequence as follows: MANKHLSLSLFLVLLGLSASLASG (SEQ ID NO: 4).

In other embodiments, an exemplary ERSP can include a yeast α-mating factor prepro peptide signal leader consisting of a 19-amino acid signal (pre) sequence followed by a 67-residue (pro) sequence containing three consensus N-linked glycosylation sites and a dibasic Kex2 endopeptidase processing site. In some embodiments, an illustrative ERSP can include a mature yeast α-mating factor. In these embodiments, an exemplary yeast α-mating factor prepro peptide signal leader and mature yeast α-mating factor can be found in *Pichia pastoris* and *Saccharomyces cerevisiae* yeast strains.

Plant ERSPs, which are selected from the genomic sequence for proteins that are known to be expressed and released into the apoplastic space of plants, and a few examples include: barley alpha-amylase signal peptide, carrot extensin, tobacco PR1. The following references provide further descriptions, and are incorporated by reference herein in their entirety. De Loose, M. et al. "The extensin signal peptide allows secretion of a heterologous protein from protoplasts" Gene, 99 (1991) 95-100. De Loose, M. et al. described the structural analysis of an extensin-encoding gene from *Nicotiana plumbaginifolia*, the sequence of which contains a typical signal peptide for translocation of the protein to the endoplasmic reticulum. Chen, M. H. et al. "Signal peptide-dependent targeting of a rice alpha-amylase and cargo proteins to plastids and extracellular compartments of plant cells" Plant Physiology, 2004 July; 135(3): 1367-77. Epub 2004 Jul. 2. Chen, M. H. et al. studied the subcellular localization of α-amylases in plant cells by analyzing the expression of α-amylase, with and without its signal peptide, in transgenic tobacco. These references and others teach and disclose the signal peptide that can be used in the methods, procedures and peptide, protein and nucleotide complexes and constructs described herein.

In some embodiments, the ERSP can be a barley alpha-amylase signal peptide, or a tobacco extensin signal peptide, or a modified tobacco extensin signal peptide, or a Jun a 3 signal peptide of *Juniperus ashei* or *J. ashei* or a signal peptide of potato proteinase inhibitor (II) (pinII). PCR primers operable to isolate the ERSP sequences from plants and other eukaryotic cells are known in the art and are commercially available.

In related embodiments, the binary and/or tertiary cleavable linking peptides coupled to an ERSP is linked to the N-terminus of a toxic peptide (TP) (ERSP-TP).

(3). Toxic Peptides (TP)

A TP of the present invention includes any polypeptide or protein having insecticidal and/or nematicidal activity when ingested by, in contact with, or injected into an insect or nematode respectively. In various embodiments, several classes of TPs that are polymers of amino acids, i.e., proteinaceous materials can be employed and synthesized as single units or multimers of the same TP species or a mixture of TP species contained within one transgenically expressed protein, wherein each of the plurality of TPs are flanked by one or two cleavable binary or tertiary peptides as described above. In various embodiments, exemplary classes of TPs useful in the insecticidal and/or nematicidal proteins described herein can include: CRIP TPs, ICK TPs, non-ICK TPs, sea anemone peptides, TMOF peptides and Bt proteins. In various embodiments, the insecticidal and/or nematicidal proteins of the present disclosure, are non-natural, man-made constructs comprising at least one binary or tertiary cleavable linker peptide and at least one TP. The insecticidal and/or nematicidal proteins of the present disclosure may be synthesized chemically, made recombinantly, and in some embodiments, are synthesized as an insecticidal and/or nematicidal protein from a polynucleotide that is inserted into a yeast cell, a plant, plant tissue or is expressed under appropriate conditions in a plant, plant tissue or a plant seed. In some embodiments, insecticidal and/or nematicidal proteins of the present disclosure include an ERSP. In related embodiments, the insecticidal and/or nematicidal proteins include an ERSP, two or more binary or tertiary cleavable linker peptides and one or more TPs positioned adjacent to a binary or tertiary cleavable linker peptides. Other multimers and polymers comprising binary and/or tertiary cleavable linker peptides and TP subunits may be synthesized and are described further herein. In related embodiments, the multimers and polymers comprising binary or tertiary cleavable linker peptides and TP subunits may also comprise an ERSP at the N-terminus of the insecticidal and/or nematicidal protein, and may also comprise a stabilizing domain (STA). In some embodiments, a STA may also include a TP, for example, an ICK TP. (See for example, FIGS. 3A and 5, 6A and 6C).

As used herein a "construct" includes a polypeptide or protein that is made up of various polypeptide units, for example, ERSP, binary or tertiary cleavable linker peptides, TPs and STA, each of these subunits are fused in frame and operable to be synthesized as a single protein. These constructs which may be written in short form designated as L for binary or tertiary cleavable linker peptides or "linker", TP for toxic proteins, ERSP for endoplasmic reticulum signal peptide, and STA for stabilization domain. In various embodiments, the insecticidal and/or nematicidal proteins of the present invention may comprise TPs that may be the same or they may be different. In addition, in some embodiments, the insecticidal and/or nematicidal proteins of the present invention may comprise binary or tertiary cleavable linker peptides that may be the same or different. In various embodiments, the insecticidal and/or nematicidal proteins of the present invention may have the same types of TPs fused with the same type of linkers, as described in the various examples of insecticidal and/or nematicidal proteins disclosed and illustrated herein, and as represented by the various constructs, insecticidal and/or nematicidal proteins and polynucleotides encoding all of the aforementioned insecticidal and/or nematicidal proteins of the present invention. In some embodiments, in the case where a DNA construct or a polynucleotide contains an open reading frame with a single TP, the TP can include Bt TPs, in addition to all of the other described TPs, with the proviso that if the DNA construct or polynucleotide contains an open reading frame containing two or more TPs, the two or more TPs cannot be Bt TPs.

An exemplary class of TPs include the Cysteine Rich Insecticidal Proteins (CRIPS). The CRIPS have 4, 6 or 8 cysteines and 2, 3 or 4 disulfide bonds. One example of this class of TPs are called inhibitor cysteine knot (ICK) motif protein. ICK motif TPs are a class of proteins with at least six cysteine residues that form a specific ICK tertiary structure. Covalent cross-linking of the cysteine residues in the ICK motif TPs form disulfide bridges that result in a tertiary structures that makes the protein relatively resistant to proteases and sometimes to extreme physical conditions (pH, temperature, UV light, etc.), and confers activity against ion channels, which may be specific to insects. Many ICK motif TPs have evolved in the venom of invertebrates and vertebrates that use the ICK motif TPs as a toxin to immobilize or kill their predators or prey. Such insecticidal peptides often have scorpion, spider and sometimes snake origins. In nature, toxic peptides can be directed to the insect's gut or to internal organs by injection. In the case of a TP of the present invention, the delivery of TPs is usually via the insect's consumption of insecticidal and/or nematicidal protein expressed in plant tissue. Upon this consumption of the toxin from its food, for example an insect feeding upon a transgenic plant, the ICK motif TP may have the ability to inhibit the growth, impair the movement, or even kill an insect.

ICK motif TPs have been shown by others to lose their toxicity when they are expressed in plants. Unless the ICK motif TP is expressed as a properly folded protein it cannot successfully protect a plant or crop from insect damage. In some cases a plant expressed peptide will need to be activated by cleavage within the insect or during expression process in a plant in order to be active. Plant expressed inhibitory cysteine knot (ICK) motif proteins from spiders and scorpions have been described (Khan et al., Transgenic Res., 2006, 15: 349-357; Hernández-Campuzano et al., Toxicon. 2009 January; 53(1):122-8.) ICK motif TP," or "inhibitor cystine knot motif protein", which is a 16 to 60 amino acid peptide with at least 6 half-cysteine core amino acids having three disulfide bridges, wherein the 3 disulfide bridges are covalent bonds and of the six half-cystine residues the covalent disulfide bonds are between the first and fourth, the second and fifth, and the third and sixth half-cystines, of the six core half-cystine amino acids starting from the N-terminal amino acid. The ICK motif TP also comprises a beta-hairpin secondary structure, normally composed of residues situated between the fourth and sixth core half-cysteines of the motif, the hairpin being stabilized by the structural crosslinking provided by the motif's three disulfide bonds. Note that additional cysteine/cysteine or half-cystine amino acids may be present within the inhibitor cysteine knot motif.

The ICK motif is common in peptides isolated from the venom of numerous species. Invertebrate species include spiders, scorpions, cone snail, sea anemone etc., other examples are numerous, even snake venom has been known to have peptides having the ICK motif. An example of ICK TPs include ACTX peptides (for example, a U-ACTX peptide, an Omega-ACTX peptide or a Kappa-ACTX peptide) from the Australian Blue Mountains Funnel-web Spider. Other ICK proteins described herein may be used to synthesize insecticidal and/or nematicidal proteins described herein.

Examples of TPs with the ICK motif can be found in the following references. The N-type calcium channel blocker co-Conotoxin was reviewed by Lew, M. J. et al. "Structure-Function Relationships of co-Conotoxin GVIA" Journal of Biological Chemistry, Vol. 272, No. 18, Issue of May 2, pp. 12014-12023, 1997. A summary of numerous arthropod toxic peptides from different spider and scorpion species was reviewed in, Quintero-Hernandez, V. et al. "Scorpion and Spider Venom Peptides: Gene Cloning and Peptide Expression" Toxicon, 58, pp. 644-663, 2011. The three-dimensional structure of Hanatoxinl using NMR spectroscopy was identified as an inhibitor cysteine knot motif in Takahashi, H. et al. "Solution structure of hanatoxinl, a gating modifier of voltage-dependent K+ channels: common surface features of gating modifier toxins" Journal of Molecular Biology, Volume 297, Issue 3, 31 Mar. 2000, pp. 771-780. The isolation and identification of cDNA encoding a scorpion venom ICK toxin peptide, Opicalcinel, was published by Zhu, S. et al. "Evolutionary origin of inhibitor cystine knot peptides" FASEB J., 2003 Sep. 17, (12):1765-7, Epub 2003 Jul. 3. The sequence-specific assignment and the secondary structure identification of BgK, a K+ channel-blocking toxin from the sea anemone Bunodosoma granulifera, was disclosed by Dauplais, M. et. al. "On the convergent evolution of animal toxins" Journal of Biological Chemistry. 1997 Feb. 14; 272(7): 4302-9. A review of the composition and pharmacology of spider venoms with emphasis on polypeptide toxin structure, mode of action, and molecular evolution showing cysteine bridges, cysteine knot formations and the "knotting-type" fold was published by Escoubas, P. et al. "Structure and pharmacology of spider venom neurotoxins" Biochimie, Vol. 82, Issues 9-10, 10 Sep. 2000, pp. 893-907. The purified peptide, iberiotoxin, an inhibitor of the Ca2+-activated K+ channel, from scorpion (Buthus tamulus) venom was disclosed in Galvez, A. et al. "Purification and characterization of a unique, potent, peptidyl probe for the high conductance calcium-activated potassium channel from venom of the scorpion Buthus tamulus" Journal of Biological Chemistry, 1990 Jul. 5; 265(19): 11083-90. The purified peptide, charybdotoxin, an inhibitor of the Ca2+-activated K+ channel, from the venom of the scorpion *Leiurus quinquestriatus* was disclosed in Gimenez-Gallego, G. et al. "Purification, sequence, and model structure of charybdotoxin, a potent selective inhibitor of calcium-activated potassium channels" Proc. Natl. Acad. Sci., 1988 May; 85(10): 3329-3333. From these and other publications, one skilled in the art should be able to readily identify proteins and peptides having what we describe as the ICK motif TP (which is used interchangeably with "ICK motif", "ICK motif protein" and the "inhibitor cystine knot motif").

In some examples, ICK motif TPs have between 26-60 amino acids in length. Some ICK motif TPs are between 16-48 amino acids in length. Some ICK motif TPs are between 26-48 amino acids in length. Some ICK motif TPs are between 30-44 amino acids in length. ICK motif TPs with natural insecticidal activity are preferred but ICK motif TPs with other types of activity such as salt and frost resistance are known to those skilled in the art and are claimed herein. Examples of ICK motif TPs include the ACTX peptides and genes, and including all of the peptides and their coding genes known as Magi6.

Specific examples of ICK motif TPs and peptides disclosed for purposes of providing examples and not intended to be limiting in any way, are the TPs and their homologs and peptide variants thereof as described above. In some embodiments, some preferred TPs are those particular peptides and nucleotides which originate from the venoms of Australian Funnel-web spiders. In various embodiments, illustrative TPs for use in the preparation of an insecticidal and/or nematicidal protein, composition, insecticidal and/or nematicidal protein, or polynucleotide encoding the same, can include one or more TPs selected from the group: U-ACTX TPs, Kappa-ACTX TPs and Omega-ACTX TPs and polynucleotides encoding the same. The following documents are incorporated by reference in the United States in their entirety, are known to one skilled in the art, and have all been published. They disclose numerous ICK motif TPs which, their full peptide sequence, their full nucleotide sequence, are specifically disclosed and are incorporated by reference, and in addition the full disclosures are incorporated by reference including all of their sequence listings. See the following references: (all incorporated herein by reference in their entireties): U.S. Pat. No. 7,354,993 B2, issued Apr. 8, 2008, specifically the peptide and nucleotide sequences listed there as SEQ ID NOs: 1-39, from U.S. Pat. No. 7,354,993 B2, and those named U-ACTX polypeptides, and these and other toxins that can form 2 to 4 intra-chain disulfide bridges, and variants thereof, and the peptides appearing on columns 4 to 9 and in FIG. 2 of U.S. Pat. No. 7,354,993 B2. Other specific sequences can be found in EP patent 1 812 464 B1, published and granted Aug. 10, 2008, see Bulletin 2008/41, specifically the peptide and nucleotide sequences listed in the sequence listing, and those the other toxins that can form 2 to 4 intra-chain disulfide bridges, and those sequences listed there as 1-39, and sequences named U-ACTX polypeptides, and variants thereof, and the peptides appearing in paragraphs 0023 to 0055, and appearing in FIG. 1 of EP patent 1 812 464 B1, the disclosures of all of the specifically enumerated patent references are incorporated by reference herein in their entireties.

Described and incorporated by reference herein as examples of insecticidal and/or nematicidal proteins and peptides are TPs including the following: peptides and variants thereof found in, isolated from, or derived from spiders of the genus *Atrax* or *Hadronyche*, including the genus species, *Hadronyche versuta*, or the Blue Mountain funnel web spider, *Atrax* robustus, *Atrax* formidabilis, *Atrax infensus*, including TPs known as U-ACTX polypeptides, which include: U-ACTX-Hv1a, U+2-ACTX-Hv1a, rU-ACTX-Hv1a, rU-ACTX-Hv1 b, or mutants or variants, especially peptides of any of these types and especially those less than about 200 amino acids but greater than about 10 amino acids, and especially peptides less than about 150 amino acids but greater than about 20 amino acids, especially peptides less than about 100 amino acids but greater than about 25 amino acids, especially peptides less than about 65 amino acids but greater than about 25 amino acids, especially peptides less than about 55 amino acids but greater than about 25 amino acids, especially peptides of about 37 or 39 or about 36 to 42 amino acids, especially peptides with less than about 55 amino acids but greater than about 25 amino acids, especially peptides with less than about 45 amino acids but greater than about 35 amino acids, especially peptides with less than about 115 amino acids but greater than about 75 amino acids, especially peptides with less than about 105 amino acids but greater than about 85 amino acids, especially peptides with less than about 100 amino acids but greater than about 90 amino acids, including peptide toxins of any of the lengths mentioned here that can form 2, 3 and or 4 or more intrachain disulfide bridges, including toxins that disrupt calcium channel currents, including toxins that disrupt potassium channel currents, especially toxins that disrupt insect calcium channels or Us thereof, especially toxins or variants thereof of any of these types, and any combination of any of the types of toxins described herein that have oral or topical insecticidal and/or nematicidal activity, can be made special by the processes described herein.

The U peptides from the Australian Funnel Web Spider, genus *Atrax* and *Hadronyche* are particularly suitable and work well when treated by the methods, procedures or processes described by this invention. Examples of such suitable peptides tested and with data are provided herein. The following species are also specifically known to carry toxic peptides suitable for plant expression as insecticidal and/or nematicidal proteins by the methods disclosed in this invention. The following species are specifically named: *Atrax formidabillis, Atrax infensus, Atrax robustus, Hadronyche infensa, Hadronyche versuta*. Any TPs derived from any of the genus and species listed above and/or genus species and may be homologous to the U peptide are suitable for plant expression as insecticidal and nematicidal proteins according to the present invention. Other TPs suitable for use in the various insecticidal and/or nematicidal polypeptides and proteins described herein, include: Kappa ACTX TPs, Omega-ACTX TPs and U-ACTX TPs.

In some embodiments, specific TPs can be cloned into proper expression vectors and along with the ERSP and cleavable linking groups disclosed herein can be made into an insecticidal and/or nematicidal protein suitable for transforming a plant, or a part thereof, or the insecticidal and/or nematicidal protein may be formulated with appropriate excipients to be applied to the surface of a plant, or plant part. In some embodiments, a suitable TP can include an ICK motif TP: QYCVP VDQPC SLNTQ PCCDD ATCTQ ERNEN GHTVYYCRA (SEQ ID NO: 6), named "U-ACTX-Hv1a," it has disulfide bridges at positions: 3-18, 10-23, 17-37. The molecular weight is 4426.84 Daltons. In another embodiment, specific TPs can be cloned into proper expression vectors and along with the ERSP and cleavable linking groups disclosed herein can be made into an insecticidal and/or nematicidal protein suitable for transforming a plant, or a part thereof, or the insecticidal and/or nematicidal protein may be formulated with appropriate excipients to be applied to the surface of a plant, or plant part. In some embodiments, a suitable TP can include an ICK motif TP: GSQYC VPVDQ PCSLN TQPCC DDATC TQERN ENGHT VYYCR A (SEQ ID NO: 5), named "U+2-ACTX-Hv1a," it has disulfide bridges at positions: 5-20, 12-25, 19-39. The molecular weight is 4564.85 Daltons. Other ICK TPs useful in the various insecticidal and/or nematicidal proteins, polynucleotides and DNA constructs encoding these insecticidal and/or nematicidal proteins, and transgenic plants or plant cells containing these insecticidal and/or nematicidal proteins, include peptides or proteins having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5-1593 and 1761-1775. In related embodiments, ICK TPs useful in the various insecticidal and/or nematicidal proteins, polynucleotides and DNA constructs encoding these insecticidal and/or nematicidal proteins, and transgenic plants or plant cells containing these insecticidal and/or nematicidal proteins, include peptides or proteins having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof.

(3A). Bt TPs

In some embodiments, illustrative TPs can also include those TPs expressed, or isolated from *Bacillus thuringiensis*, (Bt). This ubiquitous Gram-positive spore-forming bacterium provides a valuable resource due to its ability to synthesize crystal parasporal inclusions during sporulation. These crystals, which include insecticidal proteins called 0.5-endotoxins have been extensively used as biological insecticides against insect pests of commercial interest. Bt crystal toxins include the Cry proteins (crystal toxins) and Cyt proteins (cytolytic toxins). The Cry toxins are important virulence factors allowing for the development of the bacterium in dead or weakened insect larvae. The largest group of Cry toxins has three distinct structural domains; the so-called three-domain (3D) Cry toxins provide the primary focus for this review. The Cyt toxins have in vitro cytolytic activity, in addition to in vivo activity against various insects including mosquitos [5]. Cyt toxins which are active against certain Diptera, synergize the toxicity of Cry proteins against mosquitoes and delay the expression of resistance to the latter Bt proteins, or Bt peptides (collectively referred to herein as Bt TPs), are effective insecticides used for crop protection in the form of both plant incorporated protectants and foliar sprays. Commercial formulations of Bt proteins are widely used to control insects at the larval stage. The Bt Cry and Cyt proteins require solubilization in the insect midgut to produce protoxins that are typically about 130 kDa, 70 kDa or 27 kDa for Cyt. These in turn are proteolytically cleaved at the C-terminus and/or at the N-terminus by midgut proteases, generating the activated core toxin. Cry protoxins are proteolytically activated to produce the mature active toxin. Processing of the Cry protoxin into its active form is essential for toxin activity. Processing is mediated by insect proteases that cleave the protoxin polypeptide at specific sequences. The toxin then crosses the peritrophic matrix and binds to receptors in the apical membrane of the midgut cells, with receptor binding being an important determinant of toxin specificity. Toxin insertion into the epithelial membrane forms ion channels or pores, leading to lysis of the cells, damage to the midgut epithelial tissue, and death of the larva. Among susceptible species in the orders Lepidoptera and Diptera, the major gut proteases are of the serine type, while in Coleoptera the major proteases are cysteine and aspartic proteases, although some use cathepsin G serine proteases. Since activation is a crucial step to achieve toxicity, it has been suggested that the type and/or abundance of insect proteases is important in contributing to toxin specificity. In some cases, certain insects lack the ability to cleave the inactive portion from the activated or "active" portion of the Bt TP. The present invention provides for certain insecticidal and/or nematicidal proteins that have a binary or teriary cleavable linker positioned between the inactive portion and the activated or "active" portion of the Bt TP (See FIG. 3B) and insecticidal and/or nematicidal proteins that include multiple copies (for example, 2-10 copies of the Bt TP having an intervening cleavable linker positioned between the inactive and active portions of the Bt TP) in the form of insecticidal and/or nematicidal proteins and polynucleotides that encode the Bt TPs and insecticidal and/or nematicidal proteins referenced above. In some embodiments, in the case where a DNA construct or a polynucleotide contains an open reading frame with a single TP, the TP can include Bt TPs, in addition to all of the other described TPs, with the proviso that if the DNA construct or polynucleotide contains an open reading frame containing two or more TPs, the two or more TPs cannot be two or more Bt TPs.

Specific examples of Bt TPs can include peptides where the Bt Protein is a Cry or Cyt protein, and/or the Bt Protein is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1. The Bt TP can be selected from a Cry protein, a Cry1A protein or a Cry1F protein, or a combination Cry1F-Cry1A protein, or it comprises an amino acid sequence at least 90% identical to SEQ ID NOs: 10, 12, 14, 26, 28, or 34 of U.S. Pat. No. 7,304,206. We describe a transgenic plant wherein the Bt TP is Dipel and we describe a transgenic plant wherein the Bt TP is Thuricide. In another example of an insecticidal and/or nematicidal polypeptide and protein described herein, is a Cry Bt TP called Cry51. This Bt TP is disclosed in U.S. Pat. No. 8,609,936 B2 (issued on Dec. 17, 2013, the disclosure of which is incorporated by reference herein in its entirety). This Cry Bt TP is insecticidal against the genus of *lygus* plant-feeding insects. The exemplified Cry Bt TP is useful in the present invention, for example, as a TP in an insecticidal and/or nematicidal protein, or a plant or plant part thereof comprising said insecticidal and/or nematicidal polypeptide and protein, for example a plant cell, a plant tissue or plant seed.

In various embodiments, isolated nucleic acid molecules corresponding to Bt TP encoding nucleic acid sequences are provided. Additionally, amino acid sequences corresponding to the polynucleotides are encompassed. In particular, the present invention provides for an isolated nucleic acid molecule comprising a nucleotide sequence encoding the amino acid sequence shown in US 2009/0099081, published on Apr. 18, 2009, all of which is herein incorporated by reference in its entirety, and all sequences identified by number specifically incorporated by reference. Various insecticidal polypeptides and polynucleotides encoding same as disclosed in US 2009/0099081, for example, SEQ ID NOs: 9, 11, 13, 15, or 18, or a nucleotide sequence set forth in SEQ ID NOs: 1, 2, 4, 6, 7, 8, 10, 12, 14, 16, or 17, as well as variants and fragments thereof are incorporated herein by reference in its entirety. Nucleotide sequences that are complementary to a nucleotide sequence of the invention, or that hybridize to a sequence of the invention are also encompassed.

Nucleotide sequences encoding the proteins of the present invention include the sequences set forth in US 2009/0099081, published on Apr. 18, 2009, including SEQ ID NOs: 1, 2, 4, 6, 7, 8, 10, 12, 14, 16, or 17, and variants, fragments, and complementary nucleotide sequences thereof of US 2009/0099081 are incorporated herein by reference in their entirety. The term "complementary sequence" is intended a nucleotide sequence that is sufficiently complementary to a given nucleotide sequence such that it can hybridize to the given nucleotide sequence to thereby form a stable duplex. Illustrative Bt protein amino acid sequences that may be used as a TP for the compositions, transgenic molecules (polynucleotides and proteins) are set forth in the present disclosure set forth as SEQ ID NOs: 33-533.

Nucleic acid molecules that are fragments of these Bt protein encoding nucleotide sequences are also encompassed by the present invention (for example, US 2009/0099081, published on Apr. 18, 2009, all of which is herein incorporated by reference in its entirety, and all sequences identified by number specifically incorporated by reference from US 2009/0099081. SEQ ID NO: 8 is a fragment of SEQ ID NOs: 4 and 12; SEQ ID NO: 4 is a fragment of SEQ ID NO: 2 as disclosed in US 2009/0099081). By "fragment" is intended a portion of the nucleotide sequence encoding a Bt protein. A fragment of a nucleotide sequence may encode a biologically active portion of a Bt protein, or it may be a fragment that can be used as a hybridization probe or PCR primer using methods disclosed below. Nucleic acid molecules that are fragments of a Bt protein nucleotide sequence comprise at least about 50, 100, 200, 300, 400, 500, 600, 700, 800, 900, 1000, 1050, 1100, 1150, 1200, 1250, 1300, 1350, 1400, 1450, 1500, 1550, 1600, 1650, 1700, 1750, 1800, 1850, 1860, 1870, 1880, 1885 contiguous nucleotides, or up to the number of nucleotides present in a full-length Bt-protein encoding nucleotide sequence disclosed herein (for example, 1890 nucleotides for US 2009/0099081, published on Apr. 18, 2009, Here these are provided as SEQ ID NOs: 1 and 2, 1806 nucleotides for SEQ ID NO: 4, 1743 nucleotides for SEQ ID NOs: 6, 7, 8, and 16, 1809 nucleotides for SEQ ID NO: 10, and 1752 nucleotides for SEQ ID NOs: 12 and 14, in the sequence listing of US 2009/0099081). By "contiguous" nucleotides is intended nucleotide residues that are immediately adjacent to one another. Fragments of the nucleotide sequences of the present invention will encode protein fragments that retain the biological activity of the Bt protein and, hence, retain pesticidal activity. By "retains activity" is intended that the fragment will have at least about 30%, at least about 50%, at least about 70%, 80%, 90%, 95% or higher of the pesticidal activity of the Bt protein. Methods for measuring pesticidal activity are well known in the art. See, for example, Czapla and Lang (1990) J. Econ. Entomol. 83:2480-2485; Andrews et al. (1988) Biochem. J. 252:199-206; Marrone et al. (1985) J. of Economic Entomology 78:290-293; and U.S. Pat. No. 5,743,477, all of which are incorporated herein by reference in their entireties, and all sequences identified by number specifically incorporated by reference.

A fragment of a Bt protein encoding nucleotide sequence that encodes a biologically active portion of a protein of the invention will encode at least about 15, 25, 30, 50, 75, 100, 125, 150, 175, 200, 250, 300, 350, 400, 450, 500, 550, 560, 570, 575, 580, 585, 590, 595, 600 contiguous amino acids, or up to the total number of amino acids present in a full-length Bt protein of the invention (for example, 580 amino acids for SEQ ID NO: 41, 602 amino acids for SEQ ID NO: 43, and 583 amino acids for SEQ ID NOs: 45 and 47).

Preferred Bt protein proteins of the present invention are encoded by a nucleotide sequence sufficiently identical to the nucleotide sequence of US 2009/0099081, published on Apr. 18, 2009, all of which is herein incorporated by reference in its entirety, and all sequences identified by number specifically incorporated by reference, sequences 1, 2, 4, 6, 7, 8, 10, 12, 14, 16, or 17. By "sufficiently identical" is intended an amino acid or nucleotide sequence that has at least about 60% or 65% sequence identity, about 70% or 75% sequence identity, about 80% or 85% sequence identity, about 90%, 91%, 92%, 93%, 94%, 95%, 96%, 97%, 98%, 99% or greater sequence identity compared to a reference sequence using one of the alignment programs described herein using standard parameters. One of skill in the art will recognize that these values can be appropriately adjusted to determine corresponding identity of proteins encoded by two nucleotide sequences by taking into account codon degeneracy, amino acid similarity, reading frame positioning, and the like.

The invention also encompasses variant nucleic acid molecules (for example, US 2009/0099081, published on Apr. 18, 2009, all of which is herein incorporated by reference in its entirety, and all sequences identified by number specifically incorporated by reference, sequence 2 is a variant of sequence 1; sequences 7 and 8 are variants of sequence 6; sequence 10 is a variant of sequences 4 and 12; and sequence 14 is a variant of sequence 12). "Variants" of the Bt protein encoding nucleotide sequences include those sequences that encode the Bt protein disclosed herein but that differ conservatively because of the degeneracy of the genetic code as well as those that are sufficiently identical as discussed above.

Naturally occurring allelic variants can be identified with the use of well-known molecular biology techniques, such as polymerase chain reaction (PCR) and hybridization techniques as outlined below. Variant nucleotide sequences also include synthetically derived nucleotide sequences that have been generated, for example, by using site-directed mutagenesis but which still encode the Bt proteins disclosed in the present invention as discussed below. Variant proteins encompassed by the present invention are biologically active, that is they continue to possess the desired biological activity of the native protein that is, retaining insecticidal and/or nematicidal activity (also known as pesticidal activity). By "retains activity" is intended that the variant will have at least about 30%, or at least about 40%, or at least about 50%, or at least about 60%, or at least about 70%, or at least about 80%, or at least about 90% of the pesticidal activity of the native protein. Methods for measuring pesticidal activity are well known in the art. See, for example, Czapla and Lang (1990) J. Econ. Entomol. 83: 2480-2485; Andrews et al. (1988) Biochem. J. 252:199-206; Marrone et al. (1985) J. of Economic Entomology 78:290-293; and U.S. Pat. No. 5,743,477, all of which are incorporated herein by reference in their entireties, and all sequences identified by number specifically incorporated by reference.

In one aspect of the invention, some TPs that can be employed in the design and synthesis of insecticidal and/or nematicidal proteins containing cleavable linking molecules (i.e. binary and tertiary peptides) can include one or more synthetic axmi-004 Bt protein sequences, such as those disclosed in US 2009/0099081, published on Apr. 18, 2009, all of which are incorporated herein by reference in their entireties, and all sequences identified by number specifically incorporated by reference, (sequence 1) and synaxmi-004B (sequence 2). These synthetic sequences have an altered DNA sequence relative to the axmi-004 sequence (sequence 3) recited in U.S. Pat. No. 7,355,099, all of which is herein incorporated by reference in its entirety, and all sequences identified by number specifically incorporated by reference), and encode the original AXMI-004 protein. Likewise, synaxmi-004B-2M (sequence 4) was designated and encodes the axmi-004 alternate start site (herein referred to as axmi-004B-2M and set forth in sequence 5) originally identified in U.S. patent application Ser. No. 10/782,020.

Additional TPs included as possible designated axmi-004B-3M (US 2009/0099081, published on Apr. 18, 2009, all of which is herein incorporated by reference in its entirety, and all sequences identified by number specifically incorporated by reference, sequence 16) and encodes the AXMI-004B-3M amino acid sequence set forth in sequence 9. Synthetic sequences encoding the AXMI-004B-3M protein were also designated. These synthetic nucleotide sequences were designated synaxmi-004B-3M, synaxmi-004C-3M, and synaxmi-004D-3M and are set forth in sequences 6, 7, and 8, respectively. In another aspect of the invention, modified versions of the nucleotide sequence encoding AXMI-004B-3M protein were designed such that additional N-terminal residues are added to the encoded protein. These sequence are designated synaxmi-004B-3M-alt1 (US 2009/0099081, published on Apr. 18, 2009, sequence 10), synaxmi-004B-3M-alt2 (sequence 12), synaxmi-004B-3M-alt3 (sequence 14), and synaxmi-004B-3M-alt4 (sequence 17). The encoded proteins are designated AXMI-004B-3M-ALT1 (sequence 11), AXMI-004B-3M-ALT2 (sequence 13), AXMI-004B-3M-ALT3 (sequence 15), and AXMI-004B-3M-ALT4 (sequence 18).

Other Bt proteins and gene descriptions can be found in the following. Each and every patent publication referred to below with a note as to the Bt toxin to which the publication refers to, is hereby incorporated by reference in its entirely. These documents have also published and they and their sequences are in the public domain.

Additional examples of Bt genes, proteins suitable as polynucleotides encoding TPs and TPs of the present invention, and the patent documents that describe them are found in Tables 1, 2, and 3 below. The patent documents in Tables 1, 2, 3, in particular the US Patents and US applications, are hereby incorporated by reference herein in their entireties.

TABLE 1

| (e) Bt Toxins | |
|---|---|
| Toxin | Patents or Patent Publication Number |
| Cry1 | US2003046726, U.S. Pat. No. 6,833,449, CN1260397, US201026939, US2006174372, US2006174372, U.S. Pat. No. 642,241, U.S. Pat. No. 6,229,004, |

TABLE 1-continued (e) Bt Toxins

| Toxin | Patents or Patent Publication Number |
| --- | --- |
| | US2004194165, U.S. Pat. No. 6,573,240, U.S. Pat. No. 5,424,409, U.S. Pat. No. 5,407,825, U.S. Pat. No. 5,135,867, U.S. Pat. No. 5,055,294, |
| Cry1 | WO2007107302, U.S. Pat. No. 6,855,873, WO2004020636, US2007061919, U.S. Pat. No. 6,048,839, US2007061919, AU784649B, US2007061919, U.S. Pat. No. 6,150,589, U.S. Pat. No. 5,679,343, U.S. Pat. No. 5,616,319, U.S. Pat. No. 5,322,687, |
| Cry1 | WO2007107302, US2006174372, US2005091714, US2004058860, US2008020968, U.S. Pat. No. 6,043,415, U.S. Pat. No. 5,942,664, |
| Cry1 | WO2007107302, US2007061919, U.S. Pat. No. 6,172,281, |
| Cry1 | WO03082910, MX9606262, U.S. Pat. No. 5,530,195, U.S. Pat. No. 5,407,825, U.S. Pat. No. 5,045,469, |
| Cry1 | US2006174372, |
| Cry1 | US2007061919, |
| Cry1 | US2007061919, |
| Cry1 | US2007061919, CN1401772, U.S. Pat. No. 6,063,605, |
| Cry1 | US2007061919, AU784649B, U.S. Pat. No. 5,723,758, U.S. Pat. No. 5,616,319, U.S. Pat. No. 5,356,623, U.S. Pat. No. 5,322,687 |
| Cry1 | U.S. Pat. No. 5,723,758 |
| Cry2 | CN1942582, WO9840490, US2007061919, UA75570, MXPA03006130, US2003167517, U.S. Pat. No. 6,107,278, U.S. Pat. No. 6,096,708, U.S. Pat. No. 5,073,632, U.S. Pat. No. 7,208,474, U.S. Pat. No. 7,244,880, |
| Cry3 | US2002152496, RU2278161, US2003054391, |
| Cry3 | U.S. Pat. No. 5,837,237, U.S. Pat. No. 5,723,756, U.S. Pat. No. 5,683,691, U.S. Pat. No. 5,104,974, U.S. Pat. No. 4,996,155, |
| Cry3 | U.S. Pat. No. 5,837,237, U.S. Pat. No. 5,723,756, |
| Cry5 | WO9840491, US2004018982, U.S. Pat. No. 6,166,195, US2001010932, U.S. Pat. No. 5,985,831, U.S. Pat. No. 5,824,792, U.S. Pat. No. 528,153 |
| Cry5 | WO2007062064, US2001010932, U.S. Pat. No. 5,824,792, |
| Cry6 | WO2007062064, US2004018982, U.S. Pat. No. 5,973,231, U.S. Pat. No. 5,874,288, U.S. Pat. No. 5,236,843, U.S. Pat. No. 683,106 |
| Cry6 | US2004018982, U.S. Pat. No. 6,166,195, |
| Cry7 | U.S. Pat. No. 6,048,839, U.S. Pat. No. 5,683,691, U.S. Pat. No. 5,378,625, U.S. Pat. No. 518,709 |
| Cry7 | CN195215 |
| Cry8 | |
| Cry8 | |
| Cry8 | US200301796 |
| Cry8 | WO2006053473, US2007245430, |
| Cry8 | WO200605347 |
| Cry9 | US2007061919, |
| Cry9 | WO200506620 |
| Cry9 | US2007061919, U.S. Pat. No. 6,448,226, US2005097635, WO2005066202, U.S. Pat. No. 6,143,550, U.S. Pat. No. 6,028,246, U.S. Pat. No. 6,727,409, |
| Cry9 | US2005097635, WO2005066202, |
| Cry9 | U.S. Pat. No. 6,570,005, |
| Cry9 | AU784649B, US2007074308, U.S. Pat. No. 736,180 |
| Cry11 | MXPA0200870 |
| Cry12 | US2004018982, U.S. Pat. No. 6,166,195, U.S. Pat. No. 6,077,937, U.S. Pat. No. 5,824,792, U.S. Pat. No. 5,753,492, |
| Cry13 | US2004018982, U.S. Pat. No. 6,166,195, U.S. Pat. No. 6,077,937, U.S. Pat. No. 5,824,792, U.S. Pat. No. 5,753,492, |
| Cry14 | JP2007006895, U.S. Pat. No. 5,831,011, |
| Cry21 | U.S. Pat. No. 5,831,011, U.S. Pat. No. 5,670,365, |
| Cry22 | US2006218666, US2001010932, MXPA01004361, U.S. Pat. No. 5,824,792, |
| Cry22 | US2003229919, |
| Cry23 | US2006051822, US2003144192, UA75317, U.S. Pat. No. 6,399,330, U.S. Pat. No. 6,326,351, U.S. Pat. No. 6,949,626, |
| Cry26 | US200315001 |
| Cry28 | US200315001 |
| Cry31 | CA2410153, |
| Cry34 | US200316752 |
| Cry35 | US2003167522, |

TABLE 1-continued

| (e) Bt Toxins | |
|---|---|
| Toxin | Patents or Patent Publication Number |
| Cry37 | US2006051822, US2003144192, UA75317, U.S. Pat. No. 6,399,330, U.S. Pat. No. 6,326,351, U.S. Pat. No. 6,949,626, |
| Cry43 | US200527164 |
| Cyt1 | WO2007027776, |
| Cyt1 | U.S. Pat. No. 6,150,165, |
| Cyt2 | US2007163000, EP1681351, U.S. Pat. No. 6,686,452, U.S. Pat. No. 6,537,756, |

TABLE 2

| (f) Hybrid Insecticidal Crystal Proteins and Patents | |
|---|---|
| Patents[a] | Holotype Toxin[b] |
| US2008020967 | Cry29A[a] |
| US2008040827 | Cry1C[a] |
| US2007245430 | Cry8A[a] |
| US2008016596 | Cry8A[a] |
| US2008020968 | Cry1C[b] |

TABLE 3

| (g) Patents Relating to Other Hybrid Insecticidal Crystal Proteins | |
|---|---|
| Source toxins[a] | Patents[b] |
| Cry1A, Cry1C | U.S. Pat. No. 5,593,881, U.S. Pat. No. 5,932,209 |
| Cry1C, Cry1A, Cry1F | U.S. Pat. No. 6,962,705, U.S. Pat. No. 7,250,501, US2004093637 |
| Cry23A, Cry37A | U.S. Pat. No. 7,214,788 |
| Cry1A | U.S. Pat. No. 7,019,197 |
| Cry1A, Cry1B | U.S. Pat. No. 6,320,100 |
| Cry1A, Cry1C | AU2001285900B |
| Cry23A, Cry37A | US2007208168 |
| Cry3A, Cry1I, Cry1B | WO0134811 |
| Cry3A, Cry3B, Cry3C | US2004033523 |
| Cry1A, Cry1C, Cry1E, | U.S. Pat. No. 6,780,408 |
| Cry1A, Cry1F | US2008047034 |

The sequence listing of the present disclosure includes exemplary Bt TP amino acid sequences SEQ ID NOs: 33-533. These amino acid sequences include examples of Bt protein Cry and Cyt protein sequences. Examples are numerous and one skilled in the art would know of many other examples of various Bt sequences that are suitable substitutes for those in this disclosure.

(3B). TMOF TPs

In some embodiments, another source of TPs can include: Trypsin modulating oostatic factor (TMOF) peptides. TMOF peptides have to be delivered to their physiological site of action in various ways, and TMOF peptides have been identified as a potential larvicides, with great potential, see D. Borovsky, Journal of Experimental Biology 206, 3869-3875, the disclosure of which is incorporated herein by reference in its entirety.

In various embodiments, illustrative TPs include the ICK motif TP which can be any polypeptide or protein with the ICK motif ranging in length between 16 and 60 amino acids, with at least 6 cysteine residues that create covalent cross-linking disulfide bonds in the proper order.

In various embodiments, illustrative TPs include the CRIP TPs for example the ICK TPs for example, an ICK TP derived from, or originates from, *Hadronyche versuta*, or the Blue Mountain funnel web spider, *Atrax robustus, Atrax formidabilis, Atrax infensus*, including TPs known as U-ACTX polypetides, U-ACTX-Hv1a, rU-ACTX-Hv1a, rU-ACTX-Hv1b, or mutants or variants, Omega-ACTX polypeptides and variants and Kappa-ACTX polypeptides and variants. In some embodiments, illustrative CRIP TPs include a Non-ICK CRIP TP, for example, a Non-ICK CRIP TP derived from, or originates from, animals having Non-ICK CRIPS such as sea anemones, sea urchins and sea slugs and variants thereof. In one exemplary embodiment, a Non-ICK CRIP TP can be a TP derived from the sea anemone named *Anemonia viridi*, optionally including the TPs named Av2 and Av3 especially TPs similar to Av2 and Av3 including such peptides listed in the sequence listing of the present applicationor mutants or variants thereof.

In other embodiments, other TPs that can be used in the recombinant constructs and insecticidal and/or nematicidal proteins and plants described herein can include one or more of an ACTX protein, and/or a TMOF protein. TMOF motif," or "TMOF proteins" include trypsin modulating oostatic factor peptide. Numerous examples and variants of TMOF TPs are provided. SEQ ID NO: 708 in the present application is an exemplary wild type TMOF sequence. Other non-limiting variants are provided in SEQ ID NOs: 709-721. Other examples are known or could be created guided by the knowledge known in the field by one skilled in the art.

(3C). Cleavable Bt TPs

In some embodiments, a representative Bt toxic protein (TP) can include a cleavable Bt TP as provided herein that comprises a binary or tertiary peptide inserted between the active and inactive portions of the Bt TP. In one example, a binary or tertiary peptide is inserted between the cleavable pro inactive portion of the peptide and mature active portion of the peptide. In another example, a Bt TP includes a stabilizing domain fused in frame with a binary or tertiary peptide of the present invention which is fused in frame with the active portion of the Bt TP. In another example, the Bt TPs are frequently written as "cry", "cyt" or "VIP" proteins encoded by the cry, cyt and vip genes. Bt TPs are more usually attributed to insecticidal crystal proteins encoded by the cry genes. Bt TPs are examples of PFIPS (Pore Forming Insecticidal Proteins). In various embodiments, an insecticidal and/or nematicidal protein may include a protein that includes two or more binary or tertiary peptides and at least one Bt TP fused in frame with the one or more binary and/or tertiary peptides, In some embodiments, the insecticidal and/or nematicidal protein useful to provide insecticidal and/or nematicidal compositions when ingested and exposed to gut or hemolymph environments can contain a Bt TP and/or a cleavable Bt TP as described above, and further exemplified herein, containing a binary or tertiary peptide inserted between the cleavable pro (inactive) portion of the TP and mature (active) portion of the TP.

Figure 3A:
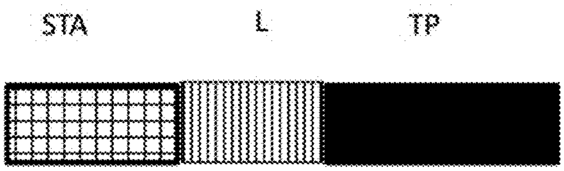
FIG. 3A. Demonstration of addition of an optional stability domain or stability protein (STA), fused to L fused to TP. This figure demonstrates an illustrative usage of a STA positioned in the N terminal position and fused in frame to an L and a TP to form an illustrative STA-L-TP construct.
Figure 3B:
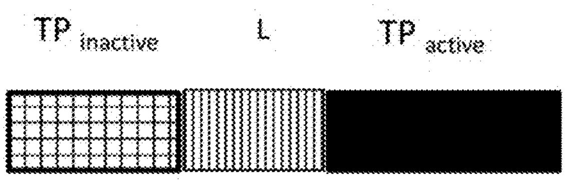
FIG. 3B depicts an embodiment in which a modified TP comprising a $TP_{inactive}$ portion of the TP is fused in frame with a cleavable (L) peptide which is fused in frame to the $TP_{active}$ portion of the TP.

For example, a binary or tertiary peptide when inserted between the cleavable pro inactive portion of the Bt TP and mature active portion of the Bt TP provides a cleavable Bt TP that upon ingestion and contact with an insect or nematode gut protease results in the cleavage of the cleavable Bt TP (See FIG. 3B). In some embodiments, an insecticidal and/or nematicidal protein containing cleavable and/or non-cleavable Bt TPs can be encoded by a DNA construct that when transformed into plants, or parts thereof, or when applied directly to the surface of plants provide insecticidal and/or nematicidal activity when the insecticidal and/or nematicidal protein is ingested and exposed to the gut and/or hemolymph environment of a target insect and/or nematode.

Described and incorporated by reference to the TPs identified herein are variants or mutant peptides and proteins of the TP amino acid sequences mentioned above, specifically, peptides and proteins having an amino acid sequence as shown in SEQ ID NO: 5-1593 and 1761-1775, having homology or sequence identity to such sequences or referred to herein, which are also identified and claimed as suitable for making special according to the processes described herein, including all homologous sequences having at least any of the following percent identities to any of the sequences disclosed here or to any sequence incorporated by reference: 50%, 55%, 60%, 65%, 70%, 75%, 80%, 85%, 90%, 95%, 96%, 97%, 98%, or 99% or greater amino acid sequence identity or 100% amino acid sequence identity to any and all sequences identified in the patents noted above, and to any other sequence identified herein, including each and every sequence in the sequence listing of this application. When the term homologous or homology is used herein with a number such as 50% or greater, then what is meant is percent identity or percent similarity between the two peptides. When homologous or homology is used without a numeric percent then it refers to two peptide sequences that are closely related in the evolutionary or developmental aspect in that they share common physical and functional aspects, like topical toxicity and similar size (i.e., the homolog being within 100% greater length or 50% shorter length of the peptide specifically mentioned herein or identified by reference herein as above). TPs of the present invention also include variants of TPs specifically disclosed or described herein, The term “variant” means a polypeptide or protein having insecticidal and/or nematicidal activity comprising an alteration, i.e., a substitution, insertion, and/or deletion, at one or more (e.g., several) positions. A substitution means replacement of the amino acid occupying a position with a different amino acid; a deletion means removal of the amino acid occupying a position; and an insertion means adding an amino acid adjacent to and immediately following the amino acid occupying a position. The TP variants of the present invention have at least 20%, e.g., at least 40%, at least 50%, at least 60%, at least 70%, at least 80%, at least 90%, at least 95%, or at least 100% of the insecticidal and/or nematicidal activity of the polypeptides and proteins of SEQ ID NO: 5-1593 and 1761-1775 and the other specifically identified TPs disclosed herein. The variants of the present invention have at least 20%, e.g., at least 40%, at least 50%, at least 60%, at least 70%, at least 80%, at least 90%, at least 95%, or at least 100% of the insecticidal and/or nematicidal activity of any one polypeptide or protein of SEQ ID NOs: 5-1593 and 1761-1775.

TPs may also include variant TP peptides and proteins encoded by a polynucleotide having one or more point mutations, for example, 1, 2, 3, 4, 5, 6, 7, 8, 9, or 10 point mutations or more, such that when the mutated TP encoding polynucleotide is transcribed and/or translated, the expressed mutated TP peptide or protein retains insecticidal and/or nematicidal activity that is at least: 90%, or 80%, or 70%, or 60%, or 50% of the insecticidal and/or nematicidal activity of the peptide or protein encoded by the corresponding non-mutated TP polynucleotide. TPs of the present invention may also include TP peptides and proteins that have at least 80%, or at least 85%, or at least 90%, or at least 95%, or at least 96% or at least 97% or at least 98% or at least 99% amino acid sequence identity to any TP disclosed in SEQ ID NO: 5-1593 and 1761-1775, and still retains at least: 95%, or 90%, or 80%, or 70%, or 60%, or 50% of the insecticidal and/or nematicidal activity of the corresponding TP set forth in SEQ ID NO: 5-1593 and 1761-1775.

The variant TPs may further comprise one or more additional substitutions at one or more (e.g., several) other positions. The amino acid changes may be of a minor nature, that is conservative amino acid substitutions or insertions that do not significantly affect the folding and/or activity of the peptide or the protein; small deletions, typically of 1-30 amino acids; small amino- or carboxyl-terminal extensions, such as an amino-terminal methionine residue; or a small extension that facilitates purification by changing net charge or another function, such as a poly-histidine tract, an antigenic epitope or a binding domain. Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, The Proteins, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly. Alternatively, the amino acid changes are of such a nature that the physico-chemical properties of the polypeptides are altered. For example, amino acid changes may improve the thermal stability of the polypeptide, alter the substrate specificity, change the pH optimum, and the like.

Essential amino acids in a peptide or protein can be identified according to procedures known in the art, such as site-directed mutagenesis or alanine-scanning mutagenesis (Cunningham and Wells, 1989, Science 244:1081-1085). In the latter technique, single alanine mutations are introduced at every residue in the molecule, and the resultant mutant molecules are tested for insecticidal or nematicidal activity to identify amino acid residues that are critical to the activity of the molecule. See also, Hilton et al., 1996, J. Biol. Chem. 271: 4699-4708. The active site of insecticidal and/or nematicidal peptide or protein or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., 1992, Science 255:306-312; Smith et al., 1992, J. Mol. Biol. 224:899-904; Wlodaver et al., 1992, FEBS Lett. 309:59-64. The identity of essential amino acids can also be inferred from an alignment with a related TP peptide or protein as disclosed herein and/or as set forth in SEQ ID NOs: 5-1593 and 1761-1775.

TPs of the present invention may also include TP peptides and proteins having 1-6 amino acid extensions fused in frame to the N-terminus or C-terminus or both termini of any TP described herein, for example a TP having an amino acid sequence as set forth in SEQ ID NOs: 5-1593 and 1761-1775. The variants can be prepared using any mutagenesis procedure known in the art, such as site-directed mutagenesis, synthetic gene construction, semi-synthetic gene construction, random mutagenesis, shuffling, etc.

Site-directed mutagenesis is a technique in which one or more (e.g., several) mutations are introduced at one or more defined sites in a polynucleotide encoding the parent. Site-directed mutagenesis can be accomplished in vitro by PCR involving the use of oligonucleotide primers containing the desired mutation. Site-directed mutagenesis can also be performed in vitro by cassette mutagenesis involving the cleavage by a restriction enzyme at a site in the plasmid comprising a polynucleotide encoding the parent and subsequent ligation of an oligonucleotide containing the mutation in the polynucleotide. Usually the restriction enzyme that digests the plasmid and the oligonucleotide is the same, permitting sticky ends of the plasmid and the insert to ligate to one another. See, e.g., Scherer and Davis, 1979, Proc. Natl. Acad. Sci. USA 76:4949-4955; and Barton et al., 1990, Nucleic Acids Res. 18:7349-4966. Site-directed mutagenesis can also be accomplished in vivo by methods known in the art. See, e.g., U.S. Patent Application Publication No. 2004/0171154; Storici et al., 2001, Nature Biotechnol. 19:773-776; Kren et al., 1998, Nat. Med. 4:285-290; and Calissano and Macino, 1996, Fungal Genet. Newslett. 43:15-16. Any site-directed mutagenesis procedure can be used in the present invention. There are many commercial kits available that can be used to prepare variant TPs of the present invention.

Synthetic gene construction entails in vitro synthesis of a designed polynucleotide molecule to encode a polypeptide of interest. Gene synthesis can be performed utilizing a number of techniques, such as the multiplex microchip-based technology described by Tian et al. (2004, Nature 432:1050-1054) and similar technologies wherein oligonucleotides are synthesized and assembled upon photo-programmable microfluidic chips.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, Science 241:53-57; Bowie and Sauer, 1989, Proc. Natl. Acad. Sci. USA 86:2152-2156; WO 95/17413; or WO 95/22625. Other methods that can be used include error-prone PCR, phage display (e.g., Lowman et al., 1991, Biochemistry 30:10832-10837; U.S. Pat. No. 5,223,409; WO 92/06204) and region-directed mutagenesis (Derbyshire et al., 1986, Gene 46:145; Ner et al., 1988, DNA 7:127).

Mutagenesis/shuffling methods can be combined with high-throughput, automated screening methods to detect activity of cloned, mutagenized polypeptides expressed by host cells (Ness et al., 1999, Nature Biotechnology 17:893-896). Mutagenized DNA molecules that encode active polypeptides can be recovered from the host cells and rapidly sequenced using standard methods in the art. These methods allow the rapid determination of the importance of individual amino acid residues in a peptide or protein.

Semi-synthetic gene construction is accomplished by combining aspects of synthetic gene construction, and/or site-directed mutagenesis, and/or random mutagenesis, and/or shuffling. Semi-synthetic construction is typified by a process utilizing polynucleotide fragments that are synthesized, in combination with PCR techniques. Defined regions of genes may thus be synthesized de novo, while other regions may be amplified using site-specific mutagenic primers, while yet other regions may be subjected to error-prone PCR or non-error prone PCR amplification. Polynucleotide subsequences may then be shuffled.

For purposes of describing the insecticidal and/or nematicidal peptides, proteins, polynucleotides encoding such insecticidal and/or nematicidal peptides and proteins, DNA constructs encoding such insecticidal and/or nematicidal peptides and proteins, transgenic plants or parts thereof containing such insecticidal and/or nematicidal peptides and proteins, and methods for controlling a pest infection or infestation and methods for increasing the yield of a crop incorporating such insecticidal and/or nematicidal peptides and proteins, TPs of the present invention also encompass (includes within its definition) variant and mutant and mutated TPs as described above within the definition of a TP or toxic peptide. In various embodiments, a TP specifically described herein include any TP having an amino acid sequence as set forth in SEQ ID NOs: 5-1593 and 1761-1775, any TP recited in any patent or non-patent reference described herein and any variant or mutant or mutated peptide or protein thereof. IN various embodiments, an insecticidal and/or nematicidal proteins described herein, include a TP having at least 80%, at least 85%, at least 90%, at least 95%, at least 96%, at least 97%, at least 98%, at least 99%, or at least 100% sequence identity or sequence homology to a peptide having an amino acid sequence as set forth in SEQ ID NOs: 5, 6 and 1761, 1762, 1767, 1771-1773, and variants thereof.

(4). Recombinant Insecticidal & Nematicidal Peptide DNA Compositions

In various embodiments, the present invention provides insecticidal and nematicidal polypeptides, proteins and DNA constructs and polynucleotides encoding such polypeptides and proteins. DNA constructs encoding such insecticidal and nematicidal polypeptides, and proteins may encompass a single polynucleotide containing the open reading frame (ORF) encoding one long fusion protein, or may encompass a number of polynucleotides which when provided in a vector enables the transcription of mRNA that encodes such insecticidal and nematicidal polypeptides as described herein. The DNA construct may also contain the necessary regulatory elements such as promoters, termination sequences, enhancers and antibiotic resistance genes that permit the DNA construct or portions thereof to be efficiently transcribed and translated in a host cell. In some embodiments, a DNA construct of the present invention can include a polynucleotide operably linked to an operable promoter, for example, a homologous or heterologous promoter, wherein the polynucleotide encodes: an insecticidal and/or nematicidal peptide comprising either a binary or a tertiary peptide, the binary or a tertiary peptide containing at least 4 amino acids and up to a maximum of 16 amino acids, and is comprised of 2 or 3 different regions, wherein the binary peptide has 2 different regions and the tertiary peptide has 3 different regions. The binary or a tertiary peptide can be cleaved by both an animal gut protease and an insect and/or nematode gut protease. In various embodiments the binary or a tertiary peptide is operably fused (i.e. fused in frame) to the C-terminus of an Endoplasmic Reticulum Signal Peptide (ERSP) as described herein and is operably fused to the N-terminus of a TP, for example a CRIP TP. (See for example, FIGS. 4-6C). In related embodiments of the above, TPs useful in the manufacture of arecombinant insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO:1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

(4a). DNA Constructs Encoding Insecticidal and Nematicidal Transgenic Proteins

In various embodiments, an illustrative DNA construct encoding the insecticidal and/or nematicidal protein may be codon optimized for the species in which the DNA construct will be introduced. For example, where the DNA construct will be transformed into plants, the DNA construct can be codon optimized for expression and replication in plant cells.

In some embodiments, the DNA construct comprises a polynucleotide that encodes a binary peptide comprising the amino acid sequence: $X_1$-$X_2$-$Y_1$-$Y_2$, $X_1$-$X_2$-$X_3$-$Y_1$-$Y_2$, $X_1$-$X_2$-$X_3$-$X_4$-$Y_1$-$Y_2$, $X_1$-$X_2$-$Y_1$-$Y_2$-$Y_3$, $X_1$-$X_2$-$X_3$-$Y_1$-$Y_2$-$Y_3$, $X_1$-$X_2$-$X_3$-$X_4$-$Y_1$-$Y_2$-$Y_3$, $X_1$-$X_2$-$Y_1$-$Y_2$-$Y_3$-$Y_4$, $X_1$-$X_2$-$X_3$-$Y_1$-$Y_2$-$Y_3$-$Y_4$, $X_1$-$X_2$-$X_3$-$X_4$-$Y_1$-$Y_2$-$Y_3$-$Y_4$, $Y_1$-$Y_2$-$X_1$-$X_2$, $Y_1$-$Y_2$-$X_1$-$X_2$-$X_3$, $Y_1$-$Y_2$-$X_1$-$X_2$-$X_3$-$X_4$, $Y_1$-$Y_2$-$Y_3$-$X_1$-$X_2$, $Y_1$-$Y_2$-$Y_3$-$X_1$-$X_2$-$X_3$, $Y_1$-$Y_2$-$Y_3$-$X_1$-$X_2$-$X_3$-$X_4$, $Y_1$-$Y_2$-$Y_3$-$Y_4$-$X_1$-$X_2$, $Y_1$-$Y_2$-$Y_3$-$Y_4$-$X_1$-$X_2$-$X_3$, $Y_1$-$Y_2$-$Y_3$-$Y_4$-$X_1$-$X_2$-$X_3$-$X_4$, wherein each $X_n$ and each $Y_n$ is an amino acid, and wherein each Xn and each Yn is an amino acid, and wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

In some embodiments, an illustrative DNA construct may encode an insecticidal and/or nematicidal protein comprising one or more illustrative binary peptides (XY or YX). In some embodiments, an exemplary DNA construct may encode an insecticidal and/or nematicidal protein comprising a cleavable binary peptide having the following amino acid sequence: AFVRLF (SEQ ID NO: 1594), AKLFV (SEQ ID NO: 1595), ALFALK (SEQ ID NO: 1596), ALFLK (SEQ ID NO: 1597), ALFLR (SEQ ID NO: 1598), ALFR (SEQ ID NO: 1599), ALFRLR (SEQ ID NO: 1600), ALKALF (SEQ ID NO: 1601), ALKFF (SEQ ID NO: 1602), ALKFLV (SEQ ID NO: 1603), ALKIFV (SEQ ID NO: 1604), ALKLFV (SEQ ID NO: 1605), FFADIK (SEQ ID NO: 1606), FFALK (SEQ ID NO: 1607), FFLK (SEQ ID NO: 1608), FFLR (SEQ ID NO: 1609), FFRLR (SEQ ID NO: 1610), FGYRIK (SEQ ID NO: 1611), FLRLF (SEQ ID NO: 1612), FYARR (SEQ ID NO: 1613), GGLRKK (SEQ ID NO: 1614), IFVALK (SEQ ID NO: 1615), IFVLK (SEQ ID NO: 1616), IFVLR (SEQ ID NO: 1617), IFVR (SEQ ID NO: 1618), IFVRLR (SEQ ID NO: 1619), ILFNIK (SEQ ID NO: 1620), LFAAPF (SEQ ID NO: 1621), FVALK (SEQ ID NO: 1622), LFVLK (SEQ ID NO: 1623), LFVLR (SEQ ID NO: 1624), LFVR (SEQ ID NO: 1625), LFVRLR (SEQ ID NO: 1626), LFVRVFL (SEQ ID NO: 1627), LGER (SEQ ID NO: 1628), LKALF (SEQ ID NO: 1629), LKFF (SEQ ID NO: 1630), LKLFV (SEQ ID NO: 1631), LKLFV (SEQ ID NO: 1632), LRALF (SEQ ID NO: 1633), LRFF (SEQ ID NO: 1634), LRIFV (SEQ ID NO: 1635), LRLFV (SEQ ID NO: 1636), RALF (SEQ ID NO: 1637), RIFV (SEQ ID NO: 1638), RLFV (SEQ ID NO: 1639), RLRALF (SEQ ID NO: 1640), RLRFF (SEQ ID NO: 1641), RLRIFV (SEQ ID NO: 1642), RLRLFV (SEQ ID NO: 1643), RRKAFV (SEQ ID NO: 1644), RRKLIF (SEQ ID NO: 1645), RRRFFA (SEQ ID NO: 1646), VFGRKG (SEQ ID NO: 1647), and YFVRK (SEQ ID NO: 1648).

In various embodiments, an exemplary DNA construct may encode an insecticidal and/or nematicidal protein comprising a cleavable tertiary peptide having the following amino acid sequence construct: $Z_1$-$X_1$-$X_2$-$Y_1$-$Y_2$, $Z_1$-$X_1$-$X_2$-$X_3$-$Y_1$-$Y_2$, $Z_1$-$X_1$-$X_2$-$X_3$-$X_4$-$Y_1$-$Y_2$, $Z_1$-$X_1$-$X_2$-$Y_1$-$Y_2$-$Y_3$, $Z_1$-$X_1$-$X_2$-$X_3$-$Y_1$-$Y_2$-$Y_3$, $Z_1$-$X_1$-$X_2$-$X_3$-$X_4$-$Y_1$-$Y_2$-$Y_3$, $Z_1$-$X_1$-$X_2$-$Y_1$-$Y_2$-$Y_3$-$Y_4$, $Z_1$-$X_1$-$X_2$-$X_3$-$Y_1$-$Y_2$-$Y_3$-$Y_4$, $Z_1$-$X_1$-$X_2$-$X_3$-$X_4$-$Y_1$-$Y_2$-$Y_3$-$Y_4$, $Z_1$-$Z_2$-$X_1$-$X_2$-$Y_1$-$Y_2$, $Z_1$-$Z_2$-$X_1$-$X_2$-$X_3$-$Y_1$-$Y_2$, $Z_1$-$Z_2$-$X_1$-$X_2$-$X_3$-$X_4$-$Y_1$-$Y_2$, $Z_1$-$Z_2$-$X_1$-$X_2$-$Y_1$-$Y_2$-$Y_3$, $Z_1$-$Z_2$-$X_1$-$X_2$-$X_3$-$Y_1$-$Y_2$-$Y_3$, $Z_1$-$Z_2$-$X_1$-$X_2$-$X_3$-$X_4$-$Y_1$-$Y_2$-$Y_3$, $Z_1$-$Z_2$-$X_1$-$X_2$-$Y_1$-$Y_2$-$Y_3$-$Y_4$, $Z_1$-$Z_2$-$X_1$-$X_2$-$X_3$-$Y_1$-$Y_2$-$Y_3$-$Y_4$, $Z_1$-$Z_2$-$X_1$-$X_2$-$X_3$-$X_4$-$Y_1$-$Y_2$-$Y_3$-$Y_4$, $Z_1$-$Z_2$-$Z_3$-$X_1$-$X_2$-$Y_1$-$Y_2$, $Z_1$-$Z_2$-$Z_3$-$X_1$-$X_2$-$X_3$-$Y_1$-$Y_2$, $Z_1$-$Z_2$-$Z_3$-$X_1$-$X_2$-$X_3$-$X_4$-$Y_1$-$Y_2$, $Z_1$-$Z_2$-$Z_3$-$X_1$-$X_2$-$Y_1$-$Y_2$-$Y_3$, $Z_1$-$Z_2$-$Z_3$-$X_1$-$X_2$-$X_3$-$Y_1$-$Y_2$-$Y_3$, $Z_1$-$Z_2$-$Z_3$-$X_1$-$X_2$-$X_3$-$X_4$-$Y_1$-$Y_2$-$Y_3$, $Z_1$-$Z_2$-$Z_3$-$X_1$-$X_2$-$Y_1$-$Y_2$-$Y_3$-$Y_4$, $Z_1$-$Z_2$-$Z_3$-$X_1$-$X_2$-$X_3$-$Y_1$-$Y_2$-$Y_3$-$Y_4$, $Z_1$-$Z_2$-$Z_3$-$X_1$-$X_2$-$X_3$-$X_4$-$Y_1$-$Y_2$-$Y_3$-$Y_4$, $Z_1$-$Z_2$-$Z_3$-$Z_4$-$X_1$-$X_2$-$Y_1$-$Y_2$, $Z_1$-$Z_2$-$Z_3$-$Z_4$-$X_1$-$X_2$-$X_3$-$Y_1$-$Y_2$, $Z_1$-$Z_2$-$Z_3$-$Z_4$-$X_1$-$X_2$-$X_3$-$X_4$-$Y_1$-$Y_2$, $Z_1$-$Z_2$-$Z_3$-$Z_4$-$X_1$-$X_2$-$Y_1$-$Y_2$-$Y_3$, $Z_1$-$Z_2$-$Z_3$-$Z_4$-$X_1$-$X_2$-$X_3$-$Y_1$-$Y_2$-$Y_3$, $Z_1$-$Z_2$-$Z_3$-$Z_4$-$X_1$-$X_2$-$X_3$-$X_4$-$Y_1$-$Y_2$-$Y_3$, $Z_1$-$Z_2$-$Z_3$-$Z_4$-$X_1$-$X_2$-$Y_1$-$Y_2$-$Y_3$-$Y_4$, $Z_1$-$Z_2$-$Z_3$-$Z_4$-$X_1$-$X_2$-$X_3$-$Y_1$-$Y_2$-$Y_3$-$Y_4$, $Z_1$-$Z_2$-$Z_3$-$Z_4$-$X_1$-$X_2$-$X_3$-$X_4$-$Y_1$-$Y_2$-$Y_3$-$Y_4$, $X_1$-$X_2$-$Y_1$-$Y_2$-$Z_1$, $X_1$-$X_2$-$X_3$-$Y_1$-$Y_2$-$Z_1$, $X_1$-$X_2$-$X_3$-$X_4$-$Y_1$-$Y_2$-$Z_1$, $X_1$-$X_2$-$Y_1$-$Y_2$-$Y_3$-$Z_1$, $X_1$-$X_2$-$X_3$-$Y_1$-$Y_2$-$Y_3$-$Z_1$, $X_1$-$X_2$-$X_3$-$X_4$-$Y_1$-$Y_2$-$Y_3$-$Z_1$, $X_1$-$X_2$-$Y_1$-$Y_2$-$Y_3$-$Y_4$-$Z_1$, $X_1$-$X_2$-$X_3$-$Y_1$-$Y_2$-$Y_3$-$Y_4$-$Z_1$, $X_1$-$X_2$-$X_3$-$X_4$-$Y_1$-$Y_2$-$Y_3$-$Y_4$-$Z_1$, $Z_1$-$X_1$-$X_2$-$Y_1$-$Y_2$-$Z_1$, $Z_1$-$X_1$-$X_2$-$X_3$-$Y_1$-$Y_2$-$Z_1$, $Z_1$-$X_1$-$X_2$-$X_3$-$X_4$-$Y_1$-$Y_2$-$Z_1$, $Z_1$-$X_1$-$X_2$-$Y_1$-$Y_2$-$Y_3$-$Z_1$, $Z_1$-$X_1$-$X_2$-$X_3$-$Y_1$-$Y_2$-$Y_3$-$Z_1$, $Z_1$-$X_1$-$X_2$-$X_3$-$X_4$-$Y_1$-$Y_2$-$Y_3$-$Z_1$, $Z_1$-$X_1$-$X_2$-$Y_1$-$Y_2$-$Y_3$-$Y_4$-$Z_1$, $Z_1$-$X_1$-$X_2$-$X_3$-$Y_1$-$Y_2$-$Y_3$-$Y_4$-$Z_1$, $Z_1$-$X_1$-$X_2$-$X_3$-$X_4$-$Y_1$-$Y_2$-$Y_3$-$Y_4$-$Z_1$, $Z_1$-$Z_2$-$X_1$-$X_2$-$Y_1$-$Y_2$-$Z_1$, $Z_1$-$Z_2$-$X_1$-$X_2$-$X_3$-$Y_1$-$Y_2$-$Z_1$, $Z_1$-$Z_2$-$X_1$-$X_2$-$X_3$-$X_4$-$Y_1$-$Y_2$-$Z_1$, $Z_1$-$Z_2$-$X_1$-$X_2$-$Y_1$-$Y_2$-$Y_3$-$Z_1$, $Z_1$-$Z_2$-$X_1$-$X_2$-$X_3$-$Y_1$-$Y_2$-$Y_3$-$Z_1$, $Z_1$-$Z_2$-$X_1$-$X_2$-$X_3$-$X_4$-$Y_1$-$Y_2$-$Y_3$-$Z_1$, $Z_1$-$Z_2$-$X_1$-$X_2$-$Y_1$-$Y_2$-$Y_3$-$Y_4$-$Z_1$, $Z_1$-$Z_2$-$X_1$-$X_2$-$X_3$-$Y_1$-$Y_2$-$Y_3$-$Y_4$-$Z_1$, $Z_1$-$Z_2$-$X_1$-$X_2$-$X_3$-$X_4$-$Y_1$-$Y_2$-$Y_3$-$Y_4$-$Z_1$, $Z_1$-$Z_2$-$Z_3$-$X_1$-$X_2$-$Y_1$-$Y_2$-$Z_1$, $Z_1$-$Z_2$-$Z_3$-$X_1$-$X_2$-$X_3$-$Y_1$-$Y_2$-$Z_1$, $Z_1$-$Z_2$-$Z_3$-$X_1$-$X_2$-$X_3$-$X_4$-$Y_1$-$Y_2$-$Z_1$, $Z_1$-$Z_2$-$Z_3$-$X_1$-$X_2$-$Y_1$-$Y_2$-$Y_3$-$Z_1$, $Z_1$-$Z_2$-$Z_3$-$X_1$-$X_2$-$X_3$-$Y_1$-$Y_2$-$Y_3$-$Z_1$, $Z_1$-$Z_2$-$Z_3$-$X_1$-$X_2$-$X_3$-$X_4$-$Y_1$-$Y_2$-$Y_3$-$Z_1$, $Z_1$-$Z_2$-$Z_3$-$X_1$-$X_2$-$Y_1$-$Y_2$-$Y_3$-$Y_4$-$Z_1$, $Z_1$-$Z_2$-$Z_3$-$X_1$-$X_2$-$X_3$-$Y_1$-$Y_2$-$Y_3$-$Y_4$-$Z_1$, $Z_1$-$Z_2$-$Z_3$-$X_1$-$X_2$-$X_3$-$X_4$-$Y_1$-$Y_2$-$Y_3$-$Y_4$-$Z_1$, $Z_1$-$Z_2$-$Z_3$-$Z_4$-$X_1$-$X_2$-$Y_1$-$Y_2$-$Z_1$, $Z_1$-$Z_2$-$Z_3$-$Z_4$-$X_1$-$X_2$-$X_3$-$Y_1$-$Y_2$-$Z_1$, $Z_1$-$Z_2$-$Z_3$-$Z_4$-$X_1$-

$X_2-X_3-X_4-Y_1-Y_2-Z_1$, $Z_1-Z_2-Z_3-Z_4-X_1-X_2-Y_1-Y_2-Y_3-Z_1$, $Z_1-Z_2-Z_3-Z_4-X_1-X_2-X_3-Y_1-Y_2-Y_3-Z_1$, $Z_1-Z_2-Z_3-Z_4-X_1-X_2-X_3-X_4-Y_1-Y_2-Y_3-Z_1$, $Z_1-Z_2-Z_3-Z_4-X_1-X_2-Y_1-Y_2-Y_3-Y_4-Z_1$, $Z_1-Z_2-Z_3-Z_4-X_1-X_2-X_3-Y_1-Y_2-Y_3-Y_4-Z_1$, $Z_1-Z_2-Z_3-Z_4-X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $Z_1-X_1-X_2-Y_1-Y_2-Z_1-Z_2$, $Z_1-X_1-X_2-X_3-Y_1-Y_2-Z_1-Z_2$, $Z_1-X_1-X_2-X_3-X_4-Y_1-Y_2-Z_1-Z_2$, $Z_1-X_1-X_2-Y_1-Y_2-Y_3-Z_1-Z_2$, $Z_1-X_1-X_2-X_3-Y_1-Y_2-Y_3-Z_1-Z_2$, $Z_1-X_1-X_2-X_3-X_4-Y_1-Y_2-Y_3-Z_1-Z_2$, $Z_1-X_1-X_2-Y_1-Y_2-Y_3-Y_4-Z_1-Z_2$, $Z_1-X_1-X_2-X_3-Y_1-Y_2-Y_3-Y_4-Z_1-Z_2$, $Z_1-X_1-X_2-X_3-X_4-Y_1-Y_2-Y_3-Y_4-Z_1-Z_2$, $Z_1-Z_2-X_1-X_2-Y_1-Y_2-Z_1-Z_2$, $Z_1-Z_2-X_1-X_2-X_3-Y_1-Y_2-Z_1-Z_2$, $Z_1-Z_2-X_1-X_2-X_3-X_4-Y_1-Y_2-Z_1-Z_2$, $Z_1-Z_2-X_1-X_2-Y_1-Y_2-Y_3-Z_1-Z_2$, $Z_1-Z_2-X_1-X_2-X_3-Y_1-Y_2-Y_3-Z_1-Z_2$, $Z_1-Z_2-X_1-X_2-X_3-X_4-Y_1-Y_2-Y_3-Z_1-Z_2$, $Z_1-Z_2-X_1-X_2-Y_1-Y_2-Y_3-Y_4-Z_1-Z_2$, $Z_1-Z_2-X_1-X_2-X_3-Y_1-Y_2-Y_3-Y_4-Z_1-Z_2$, $Z_1-Z_2-X_1-X_2-X_3-X_4-Y_1-Y_2-Y_3-Y_4-Z_1-Z_2$, $Z_1-Z_2-Z_3-X_1-X_2-Y_1-Y_2-Z_1-Z_2$, $Z_1-Z_2-Z_3-X_1-X_2-X_3-Y_1-Y_2-Z_1-Z_2$, $Z_1-Z_2-Z_3-X_1-X_2-X_3-X_4-Y_1-Y_2-Z_1-Z_2$, $Z_1-Z_2-Z_3-X_1-X_2-Y_1-Y_2-Y_3-Z_1-Z_2$, $Z_1-Z_2-Z_3-X_1-X_2-X_3-Y_1-Y_2-Y_3-Z_1-Z_2$, $Z_1-Z_2-Z_3-X_1-X_2-X_3-X_4-Y_1-Y_2-Y_3-Z_1-Z_2$, $Z_1-Z_2-Z_3-X_1-X_2-Y_1-Y_2-Y_3-Y_4-Z_1-Z_2$, $Z_1-Z_2-Z_3-X_1-X_2-X_3-Y_1-Y_2-Y_3-Y_4-Z_1-Z_2$, $Z_1-Z_2-Z_3-X_1-X_2-X_3-X_4-Y_1-Y_2-Y_3-Y_4-Z_1-Z_2$, $Z_1-Z_2-Z_3-Z_4-X_1-X_2-Y_1-Y_2-Z_1-Z_2$, $Z_1-Z_2-Z_3-Z_4-X_1-X_2-X_3-Y_1-Y_2-Z_1-Z_2$, $Z_1-Z_2-Z_3-Z_4-X_1-X_2-X_3-X_4-Y_1-Y_2-Z_1-Z_2$, $Z_1-Z_2-Z_3-Z_4-X_1-X_2-Y_1-Y_2-Y_3-Z_1-Z_2$, $Z_1-Z_2-Z_3-Z_4-X_1-X_2-X_3-Y_1-Y_2-Y_3-Z_1-Z_2$, $Z_1-Z_2-Z_3-Z_4-X_1-X_2-X_3-X_4-Y_1-Y_2-Y_3-Z_1-Z_2$, $Z_1-Z_2-Z_3-Z_4-X_1-X_2-Y_1-Y_2-Y_3-Y_4-Z_1-Z_2$, $Z_1-Z_2-Z_3-Z_4-X_1-X_2-X_3-Y_1-Y_2-Y_3-Y_4-Z_1-Z_2$, $Z_1-Z_2-Z_3-Z_4-X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $Z_1-X_1-X_2-Y_1-Y_2-Z_1-Z_2-Z_3$, $Z_1-X_1-X_2-X_3-Y_1-Y_2-Z_1-Z_2-Z_3$, $Z_1-X_1-X_2-X_3-X_4-Y_1-Y_2-Z_1-Z_2-Z_3$, $Z_1-X_1-X_2-Y_1-Y_2-Y_3-Z_1-Z_2-Z_3$, $Z_1-X_1-X_2-X_3-Y_1-Y_2-Y_3-Z_1-Z_2-Z_3$, $Z_1-X_1-X_2-X_3-X_4-Y_1-Y_2-Y_3-Z_1-Z_2-Z_3$, $Z_1-X_1-X_2-Y_1-Y_2-Y_3-Y_4-Z_1-Z_2-Z_3$, $Z_1-X_1-X_2-X_3-Y_1-Y_2-Y_3-Y_4-Z_1-Z_2-Z_3$, $Z_1-X_1-X_2-X_3-X_4-Y_1-Y_2-Y_3-Y_4-Z_1-Z_2-Z_3$, $Z_1-Z_2-X_1-X_2-Y_1-Y_2-Z_1-Z_2-Z_3$, $Z_1-Z_2-X_1-X_2-X_3-Y_1-Y_2-Z_1-Z_2-Z_3$, $Z_1-Z_2-X_1-X_2-X_3-X_4-Y_1-Y_2-Z_1-Z_2-Z_3$, $Z_1-Z_2-X_1-X_2-Y_1-Y_2-Y_3-Z_1-Z_2-Z_3$, $Z_1-Z_2-X_1-X_2-X_3-Y_1-Y_2-Y_3-Z_1-Z_2-Z_3$, $Z_1-Z_2-X_1-X_2-X_3-X_4-Y_1-Y_2-Y_3-Z_1-Z_2-Z_3$, $Z_1-Z_2-X_1-X_2-Y_1-Y_2-Y_3-Y_4-Z_1-Z_2-Z_3$, $Z_1-Z_2-X_1-X_2-X_3-Y_1-Y_2-Y_3-Y_4-Z_1-Z_2-Z_3$, $Z_1-Z_2-X_1-X_2-X_3-X_4-Y_1-Y_2-Y_3-Y_4-Z_1-Z_2-Z_3$, $Z_1-Z_2-Z_3-X_1-X_2-Y_1-Y_2-Z_1-Z_2-Z_3$, $Z_1-Z_2-Z_3-X_1-X_2-X_3-Y_1-Y_2-Z_1-Z_2-Z_3$, $Z_1-Z_2-Z_3-X_1-X_2-X_3-X_4-Y_1-Y_2-Z_1-Z_2-Z_3$, $Z_1-Z_2-Z_3-X_1-X_2-Y_1-Y_2-Y_3-Z_1-Z_2-Z_3$, $Z_1-Z_2-Z_3-X_1-X_2-X_3-Y_1-Y_2-Y_3-Z_1-Z_2-Z_3$, $Z_1-Z_2-Z_3-X_1-X_2-X_3-X_4-Y_1-Y_2-Y_3-Z_1-Z_2-Z_3$, $Z_1-Z_2-Z_3-X_1-X_2-Y_1-Y_2-Y_3-Y_4-Z_1-Z_2-Z_3$, $Z_1-Z_2-Z_3-X_1-X_2-X_3-Y_1-Y_2-Y_3-Y_4-Z_1-Z_2-Z_3$, $Z_1-Z_2-Z_3-X_1-X_2-X_3-X_4-Y_1-Y_2-Y_3-Y_4-Z_1-Z_2-Z_3$, $Z_1-Z_2-Z_3-Z_4-X_1-X_2-Y_1-Y_2-Z_1-Z_2-Z_3$, $Z_1-Z_2-Z_3-Z_4-X_1-X_2-X_3-Y_1-Y_2-Z_1-Z_2-Z_3$, $Z_1-Z_2-Z_3-Z_4-X_1-X_2-X_3-X_4-Y_1-Y_2-Z_1-Z_2-Z_3$, $Z_1-Z_2-Z_3-Z_4-X_1-X_2-Y_1-Y_2-Y_3-Z_1-Z_2-Z_3$, $Z_1-Z_2-Z_3-Z_4-X_1-X_2-X_3-Y_1-Y_2-Y_3-Z_1-Z_2-Z_3$, $Z_1-Z_2-Z_3-Z_4-X_1-X_2-X_3-X_4-Y_1-Y_2-Y_3-Z_1-Z_2-Z_3$, $Z_1-Z_2-Z_3-Z_4-X_1-X_2-Y_1-Y_2-Y_3-Y_4-Z_1-Z_2-Z_3$, $Z_1-Z_2-Z_3-Z_4-X_1-X_2-X_3-Y_1-Y_2-Y_3-Y_4-Z_1-Z_2-Z_3$, $Z_1-Z_2-Z_3-Z_4-X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Z_1-X_1-X_2-Y_1-$ $Y_2-Z_1-Z_2-Z_3-Z_4$, $Z_1-X_1-X_2-X_3-Y_1-Y_2-Z_1-Z_2-Z_3-Z_4$, $Z_1-X_1-X_2-X_3-X_4-Y_1-Y_2-Z_1-Z_2-Z_3-Z_4$, $Z_1-X_1-X_2-Y_1-Y_2-Y_3-Z_1-Z_2-Z_3-Z_4$, $Z_1-X_1-X_2-X_3-Y_1-Y_2-Y_3-Z_1-Z_2-Z_3-Z_4$, $Z_1-X_1-X_2-X_3-X_4-Y_1-Y_2-Y_3-Z_1-Z_2-Z_3-Z_4$, $Z_1-X_1-X_2-Y_1-Y_2-Y_3-Y_4-Z_1-Z_2-Z_3-Z_4$, $Z_1-X_1-X_2-X_3-Y_1-Y_2-Y_3-Y_4-Z_1-Z_2-Z_3-Z_4$, $Z_1-X_1-X_2-X_3-X_4-Y_1-Y_2-Y_3-Y_4-Z_1-Z_2-Z_3-Z_4$, $Z_1-Z_2-X_1-X_2-Y_1-Y_2-Z_1-Z_2-Z_3-Z_4$, $Z_1-Z_2-X_1-X_2-X_3-Y_1-Y_2-Z_1-Z_2-Z_3-Z_4$, $Z_1-Z_2-X_1-X_2-X_3-X_4-Y_1-Y_2-Z_1-Z_2-Z_3-Z_4$, $Z_1-Z_2-X_1-X_2-Y_1-Y_2-Y_3-Z_1-Z_2-Z_3-Z_4$, $Z_1-Z_2-X_1-X_2-X_3-Y_1-Y_2-Y_3-Z_1-Z_2-Z_3-Z_4$, $Z_1-Z_2-X_1-X_2-X_3-X_4-Y_1-Y_2-Y_3-Z_1-Z_2-Z_3-Z_4$, $Z_1-Z_2-X_1-X_2-Y_1-Y_2-Y_3-Y_4-Z_1-Z_2-Z_3-Z_4$, $Z_1-Z_2-X_1-X_2-X_3-Y_1-Y_2-Y_3-Y_4-Z_1-Z_2-Z_3-Z_4$, $Z_1-Z_2-X_1-X_2-X_3-X_4-Y_1-Y_2-Y_3-Y_4-Z_1-Z_2-Z_3-Z_4$, $Z_1-Z_2-Z_3-X_1-X_2-Y_1-Y_2-Z_1-Z_2-Z_3-Z_4$, $Z_1-Z_2-Z_3-X_1-X_2-X_3-Y_1-Y_2-Z_1-Z_2-Z_3-Z_4$, $Z_1-Z_2-Z_3-X_1-X_2-X_3-X_4-Y_1-Y_2-Z_1-Z_2-Z_3-Z_4$, $Z_1-Z_2-Z_3-X_1-X_2-Y_1-Y_2-Y_3-Z_1-Z_2-Z_3-Z_4$, $Z_1-Z_2-Z_3-X_1-X_2-X_3-Y_1-Y_2-Y_3-Z_1-Z_2-Z_3-Z_4$, $Z_1-Z_2-Z_3-X_1-X_2-X_3-X_4-Y_1-Y_2-Y_3-Z_1-Z_2-Z_3-Z_4$, $Z_1-Z_2-Z_3-X_1-X_2-Y_1-Y_2-Y_3-Y_4-Z_1-Z_2-Z_3-Z_4$, $Z_1-Z_2-Z_3-X_1-X_2-X_3-Y_1-Y_2-Y_3-Y_4-Z_1-Z_2-Z_3-Z_4$, $Z_1-Z_2-Z_3-X_1-X_2-X_3-X_4-Y_1-Y_2-Y_3-Y_4-Z_1-Z_2-Z_3-Z_4$, $Z_1-Z_2-Z_3-Z_4-X_1-X_2-Y_1-Y_2-Z_1-Z_2-Z_3-Z_4$, $Z_1-Z_2-Z_3-Z_4-X_1-X_2-X_3-Y_1-Y_2-Z_1-Z_2-Z_3-Z_4$, $Z_1-Z_2-Z_3-Z_4-X_1-X_2-X_3-X_4-Y_1-Y_2-Z_1-Z_2-Z_3-Z_4$, $Z_1-Z_2-Z_3-Z_4-X_1-X_2-Y_1-Y_2-Y_3-Z_1-Z_2-Z_3-Z_4$, $Z_1-Z_2-Z_3-Z_4-X_1-X_2-X_3-Y_1-Y_2-Y_3-Z_1-Z_2-Z_3-Z_4$, $Z_1-Z_2-Z_3-Z_4-X_1-X_2-X_3-X_4-Y_1-Y_2-Y_3-Z_1-Z_2-Z_3-Z_4$, $Z_1-Z_2-Z_3-Z_4-X_1-X_2-Y_1-Y_2-Y_3-Y_4-Z_1-Z_2-Z_3-Z_4$, $Z_1-Z_2-Z_3-Z_4-X_1-X_2-X_3-Y_1-Y_2-Y_3-Y_4-Z_1-Z_2-Z_3-Z_4$, $Z_1-Z_2-Z_3-Z_4-X_1-X_2-X_3-X_4-Y_1-Y_2-Y_3-Y_4-Z_1-Z_2-Z_3-Z_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Z_1-Y_1-Y_2-X_1-X_2-Z_1$, $Z_1-Y_1-Y_2-X_1-X_2-X_3-Z_1$, $Z_1-Y_1-Y_2-X_1-X_2-X_3-X_4-Z_1$, $Z_1-Y_1-Y_2-Y_3-X_1-X_2-Z_1$, $Z_1-Y_1-Y_2-Y_3-X_1-X_2-X_3-Z_1$, $Z_1-Y_1-Y_2-Y_3-X_1-X_2-X_3-X_4-Z_1$, $Z_1-Y_1-Y_2-Y_3-Y_4-X_1-X_2-Z_1$, $Z_1-Y_1-Y_2-Y_3-Y_4-X_1-X_2-X_3-Z_1$, $Z_1-Y_1-Y_2-Y_3-Y_4-X_1-X_2-X_3-X_4-Z_1$, $Z_1-Z_2-Y_1-Y_2-X_1-X_2-Z_1$, $Z_1-Z_2-Y_1-Y_2-X_1-X_2-X_3-Z_1$, $Z_1-Z_2-Y_1-Y_2-X_1-X_2-X_3-X_4-Z_1$, $Z_1-Z_2-Y_1-Y_2-Y_3-X_1-X_2-Z_1$, $Z_1-Z_2-Y_1-Y_2-Y_3-X_1-X_2-X_3-Z_1$, $Z_1-Z_2-Y_1-Y_2-Y_3-X_1-X_2-X_3-X_4-Z_1$, $Z_1-Z_2-Y_1-Y_2-Y_3-Y_4-X_1-X_2-Z_1$, $Z_1-Z_2-Y_1-Y_2-Y_3-Y_4-X_1-X_2-X_3-Z_1$, $Z_1-Z_2-Y_1-Y_2-Y_3-Y_4-X_1-X_2-X_3-X_4-Z_1$, $Z_1-Z_2-Z_3-Y_1-Y_2-X_1-X_2-Z_1$, $Z_1-Z_2-Z_3-Y_1-Y_2-X_1-X_2-X_3-Z_1$, $Z_1-Z_2-Z_3-Y_1-Y_2-X_1-X_2-X_3-X_4-Z_1$, $Z_1-Z_2-Z_3-Y_1-Y_2-Y_3-X_1-X_2-Z_1$, $Z_1-Z_2-Z_3-Y_1-Y_2-Y_3-X_1-X_2-X_3-Z_1$, $Z_1-Z_2-Z_3-Y_1-Y_2-Y_3-X_1-X_2-X_3-X_4-Z_1$, $Z_1-Z_2-Z_3-Y_1-Y_2-Y_3-Y_4-X_1-X_2-Z_1$, $Z_1-Z_2-Z_3-Y_1-Y_2-Y_3-Y_4-X_1-X_2-X_3-Z_1$, $Z_1-Z_2-Z_3-Y_1-Y_2-Y_3-Y_4-X_1-X_2-X_3-X_4-Z_1$, $Z_1-Z_2-Z_3-Z_4-Y_1-Y_2-X_1-X_2-Z_1$, $Z_1-Z_2-Z_3-Z_4-Y_1-Y_2-X_1-X_2-X_3-Z_1$, $Z_1-Z_2-Z_3-Z_4-Y_1-Y_2-X_1-X_2-X_3-X_4-Z_1$, $Z_1-Z_2-Z_3-Z_4-Y_1-Y_2-Y_3-X_1-X_2-Z_1$, $Z_1-Z_2-Z_3-Z_4-Y_1-Y_2-Y_3-$ $X_1-X_2-X_3-Z_1$, $Z_1-Z_2-Z_3-Z_4-Y_1-Y_2-Y_3-X_1-X_2-X_3-X_4-Z_1$, $Z_1-Z_2-Z_3-Z_4-Y_1-Y_2-Y_3-Y_4-X_1-X_2-Z_1$, $Z_1-Z_2-Z_3-Z_4-Y_1-Y_2-Y_3-Y_4-X_1-X_2-X_3-Z_1$, $Z_1-Z_2-Z_3-Z_4-Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Z_1-Y_1-Y_2-X_1-X_2-Z_1-Z_2$, $Z_1-Y_1-Y_2-X_1-X_2-X_3-Z_1-Z_2$, $Z_1-Y_1-Y_2-X_1-X_2-X_3-X_4-Z_1-Z_2$, $Z_1-Y_1-Y_2-Y_3-X_1-X_2-Z_1-Z_2$, $Z_1-Y_1-Y_2-Y_3-X_1-X_2-X_3-Z_1-Z_2$, $Z_1-Y_1-Y_2-Y_3-X_1-X_2-X_3-X_4-Z_1-Z_2$, $Z_1-Y_1-Y_2-Y_3-Y_4-X_1-X_2-Z_1-Z_2$, $Z_1-Y_1-Y_2-Y_3-Y_4-X_1-X_2-X_3-Z_1-Z_2$, $Z_1-Y_1-Y_2-Y_3-Y_4-X_1-X_2-X_3-X_4-Z_1-Z_2$, $Z_1-Z_2-Y_1-Y_2-X_1-X_2-Z_1-Z_2$, $Z_1-Z_2-Y_1-Y_2-X_1-X_2-X_3-Z_1-Z_2$, $Z_1-Z_2-Y_1-Y_2-X_1-X_2-X_3-X_4-Z_1-Z_2$, $Z_1-Z_2-Y_1-Y_2-Y_3-X_1-X_2-Z_1-Z_2$, $Z_1-Z_2-Y_1-Y_2-Y_3-X_1-X_2-X_3-Z_1-Z_2$, $Z_1-Z_2-Y_1-Y_2-Y_3-X_1-X_2-X_3-X_4-Z_1-Z_2$, $Z_1-Z_2-Y_1-Y_2-Y_3-Y_4-X_1-X_2-Z_1-Z_2$, $Z_1-Z_2-Y_1-Y_2-Y_3-Y_4-X_1-X_2-X_3-Z_1-Z_2$, $Z_1-Z_2-Y_1-Y_2-Y_3-Y_4-X_1-X_2-X_3-X_4-Z_1-Z_2$, $Z_1-Z_2-Z_3-Y_1-Y_2-X_1-X_2-Z_1-Z_2$, $Z_1-Z_2-Z_3-Y_1-Y_2-X_1-X_2-X_3-Z_1-Z_2$, $Z_1-Z_2-Z_3-Y_1-Y_2-X_1-X_2-X_3-X_4-Z_1-Z_2$, $Z_1-Z_2-Z_3-Y_1-Y_2-Y_3-X_1-X_2-Z_1-Z_2$, $Z_1-Z_2-Z_3-Y_1-Y_2-Y_3-X_1-X_2-X_3-Z_1-Z_2$, $Z_1-Z_2-Z_3-Y_1-Y_2-Y_3-X_1-X_2-X_3-X_4-Z_1-Z_2$, $Z_1-Z_2-Z_3-Y_1-Y_2-Y_3-Y_4-X_1-X_2-Z_1-Z_2$, $Z_1-Z_2-Z_3-Y_1-Y_2-Y_3-Y_4-X_1-X_2-X_3-Z_1-Z_2$, $Z_1-Z_2-Z_3-Y_1-Y_2-Y_3-Y_4-X_1-X_2-X_3-X_4-Z_1-Z_2$, $Z_1-Z_2-Z_3-Z_4-Y_1-Y_2-X_1-X_2-Z_1-Z_2$, $Z_1-Z_2-Z_3-Z_4-Y_1-Y_2-X_1-X_2-X_3-Z_1-Z_2$, $Z_1-Z_2-Z_3-Z_4-Y_1-Y_2-X_1-X_2-X_3-X_4-Z_1-Z_2$, $Z_1-Z_2-Z_3-Z_4-Y_1-Y_2-Y_3-X_1-X_2-Z_1-Z_2$, $Z_1-Z_2-Z_3-Z_4-Y_1-Y_2-Y_3-X_1-X_2-X_3-Z_1-Z_2$, $Z_1-Z_2-Z_3-Z_4-Y_1-Y_2-Y_3-X_1-X_2-X_3-X_4-Z_1-Z_2$, $Z_1-Z_2-Z_3-Z_4-Y_1-Y_2-Y_3-Y_4-X_1-X_2-Z_1-Z_2$, $Z_1-Z_2-Z_3-Z_4-Y_1-Y_2-Y_3-Y_4-X_1-X_2-X_3-Z_1-Z_2$, $Z_1-Z_2-Z_3-Z_4-Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Z_1-Y_1-Y_2-X_1-X_2-Z_1-Z_2-Z_3$, $Z_1-Y_1-Y_2-X_1-X_2-X_3-Z_1-Z_2-Z_3$, $Z_1-Y_1-Y_2-X_1-X_2-X_3-X_4-Z_1-Z_2-Z_3$, $Z_1-Y_1-Y_2-Y_3-X_1-X_2-Z_1-Z_2-Z_3$, $Z_1-Y_1-Y_2-Y_3-X_1-X_2-X_3-Z_1-Z_2-Z_3$, $Z_1-Y_1-Y_2-Y_3-X_1-X_2-X_3-X_4-Z_1-Z_2-Z_3$, $Z_1-Y_1-Y_2-Y_3-Y_4-X_1-X_2-Z_1-Z_2-Z_3$, $Z_1-Y_1-Y_2-Y_3-Y_4-X_1-X_2-X_3-Z_1-Z_2-Z_3$, $Z_1-Y_1-Y_2-Y_3-Y_4-X_1-X_2-X_3-X_4-Z_1-Z_2-Z_3$, $Z_1-Z_2-Y_1-Y_2-X_1-X_2-Z_1-Z_2-Z_3$, $Z_1-Z_2-Y_1-Y_2-X_1-X_2-X_3-Z_1-Z_2-Z_3$, $Z_1-Z_2-Y_1-Y_2-X_1-X_2-X_3-X_4-Z_1-Z_2-Z_3$, $Z_1-Z_2-Y_1-Y_2-Y_3-X_1-X_2-Z_1-Z_2-Z_3$, $Z_1-Z_2-Y_1-Y_2-Y_3-X_1-X_2-X_3-Z_1-Z_2-Z_3$, $Z_1-Z_2-Y_1-Y_2-Y_3-X_1-X_2-X_3-X_4-Z_1-Z_2-Z_3$, $Z_1-Z_2-Y_1-Y_2-Y_3-Y_4-X_1-X_2-Z_1-Z_2-Z_3$, $Z_1-Z_2-Y_1-Y_2-Y_3-Y_4-X_1-X_2-X_3-Z_1-Z_2-Z_3$, $Z_1-Z_2-Y_1-Y_2-Y_3-Y_4-X_1-X_2-X_3-X_4-Z_1-Z_2-Z_3$, $Z_1-Z_2-Z_3-Y_1-Y_2-X_1-X_2-Z_1-Z_2-Z_3$, $Z_1-Z_2-Z_3-Y_1-Y_2-X_1-X_2-X_3-Z_1-Z_2-Z_3$, $Z_1-Z_2-Z_3-Y_1-Y_2-X_1-X_2-X_3-X_4-Z_1-Z_2-Z_3$, $Z_1-Z_2-Z_3-Y_1-Y_2-Y_3-X_1-X_2-Z_1-Z_2-Z_3$, $Z_1-Z_2-Z_3-Y_1-Y_2-Y_3-X_1-X_2-X_3-Z_1-Z_2-Z_3$, $Z_1-Z_2-Z_3-Y_1-Y_2-Y_3-X_1-X_2-X_3-X_4-Z_1-Z_2-Z_3$, $Z_1-Z_2-Z_3-Y_1-Y_2-Y_3-Y_4-X_1-X_2-Z_1-Z_2-Z_3$, $Z_1-Z_2-Z_3-Y_1-Y_2-Y_3-Y_4-X_1-X_2-X_3-Z_1-Z_2-Z_3$, $Z_1-Z_2-Z_3-Y_1-Y_2-Y_3-Y_4-X_1-X_2-X_3-X_4-Z_1-Z_2-Z_3$, $Z_1-Z_2-Z_3-Z_4-Y_1-Y_2-X_1-X_2-Z_1-Z_2-Z_3$, $Z_1-Z_2-Z_3-Z_4-Y_1-Y_2-X_1-X_2-X_3-Z_1-Z_2-Z_3$, $Z_1-Z_2-Z_3-Z_4-Y_1-Y_2-X_1-X_2-X_3-X_4-Z_1-Z_2-Z_3$, $Z_1-Z_2-Z_3-Z_4-Y_1-Y_2-Y_3-X_1-X_2-Z_1-Z_2-Z_3$, $Z_1-Z_2-Z_3-Z_4-Y_1-Y_2-Y_3-X_1-X_2-X_3-Z_1-Z_2-Z_3$, $Z_1-Z_2-Z_3-Z_4-Y_1-Y_2-Y_3-X_1-X_2-X_3-X_4-Z_1-Z_2-Z_3$, $Z_1-Z_2-Z_3-Z_4-Y_1-Y_2-Y_3-Y_4-X_1-X_2-Z_1-Z_2-Z_3$, $Z_1-Z_2-Z_3-Z_4-Y_1-Y_2-Y_3-Y_4-X_1-X_2-X_3-Z_1-Z_2-Z_3$, $Z_1-Z_2-Z_3-Z_4-Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-Y_1-Y_2-X_1-X_2-Z_1-Z_2-Z_3-Z_4$, $Z_1-Y_1-Y_2-X_1-X_2-X_3-Z_1-Z_2-Z_3-Z_4$, $Z_1-Y_1-Y_2-X_1-X_2-X_3-X_4-Z_1-Z_2-Z_3-Z_4$, $Z_1-Y_1-Y_2-Y_3-X_1-X_2-Z_1-Z_2-Z_3-Z_4$, $Z_1-Y_1-Y_2-Y_3-X_1-X_2-X_3-Z_1-Z_2-Z_3-Z_4$, $Z_1-Y_1-Y_2-Y_3-X_1-X_2-X_3-X_4-Z_1-Z_2-Z_3-Z_4$, $Z_1-Y_1-Y_2-Y_3-Y_4-X_1-X_2-Z_1-Z_2-Z_3-Z_4$, $Z_1-Y_1-Y_2-Y_3-Y_4-X_1-X_2-X_3-Z_1-Z_2-Z_3-Z_4$, $Z_1-Y_1-Y_2-Y_3-Y_4-X_1-X_2-X_3-X_4-Z_1-Z_2-Z_3-Z_4$, $Z_1-Z_2-Y_1-Y_2-X_1-X_2-Z_1-Z_2-Z_3-Z_4$, $Z_1-Z_2-Y_1-Y_2-X_1-X_2-X_3-Z_1-Z_2-Z_3-Z_4$, $Z_1-Z_2-Y_1-Y_2-X_1-X_2-X_3-X_4-Z_1-Z_2-Z_3-Z_4$, $Z_1-Z_2-Y_1-Y_2-Y_3-X_1-X_2-Z_1-Z_2-Z_3-Z_4$, $Z_1-Z_2-Y_1-Y_2-Y_3-X_1-X_2-X_3-Z_1-Z_2-Z_3-Z_4$, $Z_1-Z_2-Y_1-Y_2-Y_3-X_1-X_2-X_3-X_4-Z_1-Z_2-Z_3-Z_4$, $Z_1-Z_2-Y_1-Y_2-Y_3-Y_4-X_1-X_2-Z_1-Z_2-Z_3-Z_4$, $Z_1-Z_2-Y_1-Y_2-Y_3-Y_4-X_1-X_2-X_3-Z_1-Z_2-Z_3-Z_4$, $Z_1-Z_2-Y_1-Y_2-Y_3-Y_4-X_1-X_2-X_3-X_4-Z_1-Z_2-Z_3-Z_4$, $Z_1-Z_2-Z_3-Y_1-Y_2-X_1-X_2-Z_1-Z_2-Z_3-Z_4$, $Z_1-Z_2-Z_3-Y_1-Y_2-X_1-X_2-X_3-Z_1-Z_2-Z_3-Z_4$, $Z_1-Z_2-Z_3-Y_1-Y_2-X_1-X_2-X_3-X_4-Z_1-Z_2-Z_3-Z_4$, $Z_1-Z_2-Z_3-Y_1-Y_2-Y_3-X_1-X_2-Z_1-Z_2-Z_3-Z_4$, $Z_1-Z_2-Z_3-Y_1-Y_2-Y_3-X_1-X_2-X_3-Z_1-Z_2-Z_3-Z_4$, $Z_1-Z_2-Z_3-Y_1-Y_2-Y_3-X_1-X_2-X_3-X_4-Z_1-Z_2-Z_3-Z_4$, $Z_1-Z_2-Z_3-Y_1-Y_2-Y_3-Y_4-X_1-X_2-Z_1-Z_2-Z_3-Z_4$, $Z_1-Z_2-Z_3-Y_1-Y_2-Y_3-Y_4-X_1-X_2-X_3-Z_1-Z_2-Z_3-Z_4$, $Z_1-Z_2-Z_3-Y_1-Y_2-Y_3-Y_4-X_1-X_2-X_3-X_4-Z_1-Z_2-Z_3-Z_4$, $Z_1-Z_2-Z_3-Z_4-Y_1-Y_2-X_1-X_2-Z_1-Z_2-Z_3-Z_4$, $Z_1-Z_2-Z_3-Z_4-Y_1-Y_2-X_1-X_2-X_3-Z_1-Z_2-Z_3-Z_4$, $Z_1-Z_2-Z_3-Z_4-Y_1-Y_2-X_1-X_2-X_3-X_4-Z_1-Z_2-Z_3-Z_4$, $Z_1-Z_2-Z_3-Z_4-Y_1-Y_2-Y_3-X_1-X_2-Z_1-Z_2-Z_3-Z_4$, $Z_1-Z_2-Z_3-Z_4-Y_1-Y_2-Y_3-X_1-X_2-X_3-Z_1-Z_2-Z_3-Z_4$, $Z_1-Z_2-Z_3-Z_4-Y_1-Y_2-Y_3-X_1-X_2-X_3-X_4-Z_1-Z_2-Z_3-Z_4$, $Z_1-Z_2-Z_3-Z_4-Y_1-Y_2-Y_3-Y_4-X_1-X_2-Z_1-Z_2-Z_3-Z_4$, $Z_1-Z_2-Z_3-Z_4-Y_1-Y_2-Y_3-Y_4-X_1-X_2-X_3-Z_1-Z_2-Z_3-Z_4$, $Z_1-Z_2-Z_3-Z_4-Y_1-Y_2-Y_3-Y_4-X_1-X_2-X_3-X_4-Z_1-Z_2-Z_3-Z_4$, $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2-X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2-X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3-Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3-Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1$-

$Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4$, $X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4$, $Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4$, $Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1$, $X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2$, $X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2$, $X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3$, $Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3$, $Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1-Y_2-Y_3-Y_4-Z_1$, $Z_1-X_1-X_2-Y_1-Y_2-Z_1$, $Z_1-X_1-X_2-X_3-Y_1-Y_2-Z_1$, $Z_1-X_1-X_2-X_3-X_4-Y_1-Y_2-Z_1$, $Z_1-X_1-X_2-Y_1-Y_2-Y_3-Z_1$, $Z_1-X_1-X_2-X_3-Y_1-Y_2-Y_3-Z_1$, $Z_1-X_1-X_2-X_3-X_4-Y_1-Y_2-Y_3-Z_1$, $Z_1-X_1-X_2-Y_1-Y_2-Y_3-Y_4-Z_1$, $Z_1-X_1-X_2-X_3-Y_1-Y_2-Y_3-Y_4-Z_1$, $Z_1-X_1-X_2-X_3-X_4-Y_1-Y_2-Y_3-Y_4-Z_1$, $Z_1-Z_2-X_1-X_2-Y_1-Y_2-Z_1$, $Z_1-Z_2-X_1-X_2-X_3-Y_1-Y_2-Z_1$, $Z_1-Z_2-X_1-X_2-X_3-X_4-Y_1-Y_2-Z_1$, $Z_1-Z_2-X_1-X_2-Y_1-Y_2-Y_3-Z_1$, $Z_1-Z_2-X_1-X_2-X_3-Y_1-Y_2-Y_3-Z_1$, $Z_1-Z_2-X_1-X_2-X_3-X_4-Y_1-Y_2-Y_3-Z_1$, $Z_1-Z_2-X_1-X_2-Y_1-Y_2-Y_3-Y_4-Z_1$, $Z_1-Z_2-X_1-X_2-X_3-Y_1-Y_2-Y_3-Y_4-Z_1$, $Z_1-Z_2-X_1-X_2-X_3-X_4-Y_1-Y_2-Y_3-Y_4-Z_1$, $Z_1-Z_2-Z_3-X_1-X_2-Y_1-Y_2-Z_1$, $Z_1-Z_2-Z_3-X_1-X_2-X_3-Y_1-Y_2-Z_1$, $Z_1-Z_2-Z_3-X_1-X_2-X_3-X_4-Y_1-Y_2-Z_1$, $Z_1-Z_2-Z_3-X_1-X_2-Y_1-Y_2-Y_3-Z_1$, $Z_1-Z_2-Z_3-X_1-X_2-X_3-Y_1-Y_2-Y_3-Z_1$, $Z_1-Z_2-Z_3-X_1-X_2-X_3-X_4-Y_1-Y_2-Y_3-Z_1$, $Z_1-Z_2-Z_3-X_1-X_2-Y_1-Y_2-Y_3-Y_4-Z_1$, $Z_1-Z_2-Z_3-X_1-X_2-X_3-Y_1-Y_2-Y_3-Y_4-Z_1$, $Z_1-Z_2-Z_3-X_1-X_2-X_3-X_4-Y_1-Y_2-Y_3-Y_4-Z_1$, $Z_1-Z_2-Z_3-Z_4-X_1-X_2-Y_1-Y_2-Z_1$, $Z_1-Z_2-Z_3-Z_4-X_1-X_2-X_3-Y_1-Y_2-Z_1$, $Z_1-Z_2-Z_3-Z_4-X_1-X_2-X_3-X_4-Y_1-Y_2-Z_1$, $Z_1-Z_2-Z_3-Z_4-X_1-X_2-Y_1-Y_2-Y_3-Z_1$, $Z_1-Z_2-Z_3-Z_4-X_1-X_2-X_3-Y_1-Y_2-Y_3-Z_1$, $Z_1-Z_2-Z_3-Z_4-X_1-X_2-X_3-X_4-Y_1-Y_2-Y_3-Z_1$, $Z_1-Z_2-Z_3-Z_4-X_1-X_2-Y_1-Y_2-Y_3-Y_4-Z_1$, $Z_1-Z_2-Z_3-Z_4-X_1-X_2-X_3-Y_1-Y_2-Y_3-Y_4-Z_1$, $Z_1-Z_2-Z_3-Z_4-X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $Z_1-X_1-X_2-Y_1-Y_2-Z_1-Z_2$, $Z_1-X_1-X_2-X_3-Y_1-Y_2-Z_1-Z_2$, $Z_1-X_1-X_2-X_3-X_4-Y_1-Y_2-Z_1-Z_2$, $Z_1-X_1-X_2-Y_1-Y_2-Y_3-Z_1-Z_2$, $Z_1-X_1-X_2-X_3-Y_1-Y_2-Y_3-Z_1-Z_2$, $Z_1-X_1-X_2-X_3-X_4-Y_1-Y_2-Y_3-Z_1-Z_2$, $Z_1-X_1-X_2-Y_1-Y_2-Y_3-Y_4-Z_1-Z_2$, $Z_1-X_1-X_2-X_3-Y_1-Y_2-Y_3-Y_4-Z_1-Z_2$, $Z_1-X_1-X_2-X_3-X_4-Y_1-Y_2-Y_3-Y_4-Z_1-Z_2$, $Z_1-Z_2-X_1-X_2-Y_1-Y_2-Z_1-Z_2$, $Z_1-Z_2-X_1-X_2-X_3-Y_1-Y_2-Z_1-Z_2$, $Z_1-Z_2-X_1-X_2-X_3-X_4-Y_1-Y_2-Z_1-Z_2$, $Z_1-Z_2-X_1-X_2-Y_1-Y_2-Y_3-Z_1-Z_2$, $Z_1-Z_2-X_1-X_2-X_3-Y_1-Y_2-Y_3-Z_1-Z_2$, $Z_1-Z_2-X_1-X_2-X_3-X_4-Y_1-Y_2-Y_3-Z_1-Z_2$, $Z_1-Z_2-X_1-X_2-Y_1-Y_2-Y_3-Y_4-Z_1-Z_2$, $Z_1-Z_2-X_1-X_2-X_3-Y_1-Y_2-Y_3-Y_4-Z_1-Z_2$, $Z_1-Z_2-X_1-X_2-X_3-X_4-Y_1-Y_2-Y_3-Y_4-Z_1-Z_2$, $Z_1-Z_2-Z_3-X_1-X_2-Y_1-Y_2-Z_1-Z_2$, $Z_1-Z_2-Z_3-X_1-X_2-X_3-Y_1-Y_2-Z_1-Z_2$, $Z_1-Z_2-Z_3-X_1-X_2-X_3-X_4-Y_1-Y_2-Z_1-Z_2$, $Z_1-Z_2-Z_3-X_1-X_2-Y_1-Y_2-Y_3-Z_1-Z_2$, $Z_1-Z_2-Z_3-X_1-X_2-X_3-Y_1-Y_2-Y_3-Z_1-Z_2$, $Z_1-Z_2-Z_3-X_1-X_2-X_3-X_4-Y_1-Y_2-Y_3-Z_1-Z_2$, $Z_1-Z_2-Z_3-X_1-X_2-Y_1-Y_2-Y_3-Y_4-Z_1-Z_2$, $Z_1-Z_2-Z_3-X_1-X_2-X_3-Y_1-Y_2-Y_3-Y_4-Z_1-Z_2$, $Z_1-Z_2-Z_3-X_1-X_2-X_3-X_4-Y_1-Y_2-Y_3-Y_4-Z_1-Z_2$, $Z_1-Z_2-Z_3-Z_4-X_1-X_2-Y_1-Y_2-Z_1-Z_2$, $Z_1-Z_2-Z_3-Z_4-X_1-X_2-X_3-Y_1-Y_2-Z_1-Z_2$, $Z_1-Z_2-Z_3-Z_4-X_1-X_2-X_3-X_4-Y_1-Y_2-Z_1-Z_2$, $Z_1-Z_2-Z_3-Z_4-X_1-X_2-Y_1-Y_2-Y_3-Z_1-Z_2$, $Z_1-Z_2-Z_3-Z_4-X_1-X_2-X_3-Y_1-Y_2-Y_3-Z_1-Z_2$, $Z_1-Z_2-Z_3-Z_4-X_1-X_2-X_3-X_4-Y_1-Y_2-Y_3-Z_1-Z_2$, $Z_1-Z_2-Z_3-Z_4-X_1-X_2-Y_1-Y_2-Y_3-Y_4-Z_1-Z_2$, $Z_1-Z_2-Z_3-Z_4-X_1-X_2-X_3-Y_1-Y_2-Y_3-Y_4-Z_1-Z_2$, $Z_1-Z_2-Z_3-Z_4-X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $Z_1-X_1-X_2-Y_1-Y_2-Z_1-Z_2-Z_3$, $Z_1-X_1-X_2-X_3-Y_1-Y_2-Z_1-Z_2-Z_3$, $Z_1-X_1-X_2-X_3-X_4-Y_1-Y_2-Z_1-Z_2-Z_3$, $Z_1-X_1-X_2-Y_1-Y_2-Y_3-Z_1-Z_2-Z_3$, $Z_1-X_1-X_2-X_3-Y_1-Y_2-Y_3-Z_1-Z_2-Z_3$, $Z_1-X_1-X_2-X_3-X_4-Y_1-Y_2-Y_3-Z_1-Z_2-Z_3$, $Z_1-X_1-X_2-Y_1-Y_2-Y_3-Y_4-Z_1-Z_2-Z_3$, $Z_1-X_1-X_2-X_3-Y_1-Y_2-Y_3-Y_4-Z_1-Z_2-Z_3$, $Z_1-X_1-X_2-X_3-X_4-Y_1-Y_2-Y_3-Y_4-Z_1-Z_2-Z_3$, $Z_1-Z_2-X_1-X_2-Y_1-Y_2-Z_1-Z_2-Z_3$, $Z_1-Z_2-X_1-X_2-X_3-Y_1-Y_2-Z_1-Z_2-Z_3$, $Z_1-Z_2-X_1-X_2-X_3-X_4-Y_1-Y_2-Z_1-Z_2-Z_3$, $Z_1-Z_2-X_1-X_2-Y_1-Y_2-Y_3-Z_1-Z_2-Z_3$, $Z_1-Z_2-X_1-X_2-X_3-Y_1-Y_2-Y_3-Z_1-Z_2-Z_3$, $Z_1-Z_2-X_1-X_2-X_3-X_4-Y_1-Y_2-Y_3-Z_1-Z_2-Z_3$, $Z_1-Z_2-X_1-X_2-Y_1-Y_2-Y_3-Y_4-Z_1-Z_2-Z_3$, $Z_1-Z_2-X_1-X_2-X_3-Y_1-Y_2-Y_3-Y_4-Z_1-Z_2-Z_3$, $Z_1-Z_2-X_1-X_2-X_3-X_4-Y_1-Y_2-Y_3-Y_4-Z_1-Z_2-Z_3$, $Z_1-Z_2-Z_3-X_1-X_2-Y_1-Y_2-Z_1-Z_2-Z_3$, $Z_1-Z_2-Z_3-X_1-X_2-X_3-Y_1-Y_2-Z_1-Z_2-Z_3$, $Z_1-Z_2-Z_3-X_1-X_2-X_3-X_4-Y_1-Y_2-Z_1-Z_2-Z_3$, $Z_1-Z_2-Z_3-X_1-X_2-Y_1-Y_2-Y_3-Z_1-Z_2-Z_3$, $Z_1-Z_2-Z_3-X_1-X_2-X_3-Y_1-Y_2-Y_3-Z_1-Z_2-Z_3$, $Z_1-Z_2-Z_3-X_1-X_2-X_3-X_4-Y_1-Y_2-Y_3-Z_1-Z_2-Z_3$, $Z_1-Z_2-Z_3-X_1-X_2-Y_1-Y_2-Y_3-Y_4-Z_1-Z_2-Z_3$, $Z_1-Z_2-Z_3-X_1-X_2-X_3-Y_1-Y_2-Y_3-Y_4-Z_1-Z_2-Z_3$, $Z_1-Z_2-Z_3-X_1-X_2-X_3-X_4-Y_1-Y_2-Y_3-Y_4-Z_1-Z_2-Z_3$, $Z_1-Z_2-Z_3-Z_4-X_1-X_2-Y_1-Y_2-Z_1-Z_2-Z_3$, $Z_1-Z_2-Z_3-Z_4-X_1-X_2-X_3-Y_1-Y_2-Z_1-Z_2-Z_3$, $Z_1-Z_2-Z_3-Z_4-X_1-X_2-X_3-X_4-Y_1-Y_2-Z_1-Z_2-Z_3$, $Z_1-Z_2-Z_3-Z_4-X_1-X_2-Y_1-Y_2-Y_3-Z_1-Z_2-Z_3$, $Z_1-Z_2-Z_3-Z_4-X_1-X_2-X_3-Y_1-Y_2-Y_3-Z_1-Z_2-Z_3$, $Z_1-Z_2-Z_3-Z_4-X_1-X_2-X_3-X_4-Y_1-Y_2-Y_3-Z_1-Z_2-Z_3$, $Z_1-Z_2-Z_3-Z_4-X_1-X_2-Y_1-Y_2-Y_3-Y_4-Z_1-Z_2-Z_3$, $Z_1-Z_2-Z_3-Z_4-X_1-X_2-X_3-Y_1-Y_2-Y_3-Y_4-Z_1-Z_2-Z_3$, $Z_1-Z_2-$ $Z_3-Z_4-X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Z_1-X_1-X_2-Y_1-Y_2-Z_1-Z_2-Z_3-Z_4$, $Z_1-X_1-X_2-X_3-Y_1-Y_2-Z_1-Z_2-Z_3-Z_4$, $Z_1-X_1-X_2-X_3-X_4-Y_1-Y_2-Z_1-Z_2-Z_3-Z_4$, $Z_1-X_1-X_2-Y_1-Y_2-Y_3-Z_1-Z_2-Z_3-Z_4$, $Z_1-X_1-X_2-X_3-Y_1-Y_2-Y_3-Z_1-Z_2-Z_3-Z_4$, $Z_1-X_1-X_2-X_3-X_4-Y_1-Y_2-Y_3-Z_1-Z_2-Z_3-Z_4$, $Z_1-X_1-X_2-Y_1-Y_2-Y_3-Y_4-Z_1-Z_2-Z_3-Z_4$, $Z_1-X_1-X_2-X_3-Y_1-Y_2-Y_3-Y_4-Z_1-Z_2-Z_3-Z_4$, $Z_1-X_1-X_2-X_3-X_4-Y_1-Y_2-Y_3-Y_4-Z_1-Z_2-Z_3-Z_4$, $Z_1-Z_2-X_1-X_2-Y_1-Y_2-Z_1-Z_2-Z_3-Z_4$, $Z_1-Z_2-X_1-X_2-X_3-Y_1-Y_2-Z_1-Z_2-Z_3-Z_4$, $Z_1-Z_2-X_1-X_2-X_3-X_4-Y_1-Y_2-Z_1-Z_2-Z_3-Z_4$, $Z_1-Z_2-X_1-X_2-Y_1-Y_2-Y_3-Z_1-Z_2-Z_3-Z_4$, $Z_1-Z_2-X_1-X_2-X_3-Y_1-Y_2-Y_3-Z_1-Z_2-Z_3-Z_4$, $Z_1-Z_2-X_1-X_2-X_3-X_4-Y_1-Y_2-Y_3-Z_1-Z_2-Z_3-Z_4$, $Z_1-Z_2-X_1-X_2-Y_1-Y_2-Y_3-Y_4-Z_1-Z_2-Z_3-Z_4$, $Z_1-Z_2-X_1-X_2-X_3-Y_1-Y_2-Y_3-Y_4-Z_1-Z_2-Z_3-Z_4$, $Z_1-Z_2-X_1-X_2-X_3-X_4-Y_1-Y_2-Y_3-Y_4-Z_1-Z_2-Z_3-Z_4$, $Z_1-Z_2-Z_3-X_1-X_2-Y_1-Y_2-Z_1-Z_2-Z_3-Z_4$, $Z_1-Z_2-Z_3-X_1-X_2-X_3-Y_1-Y_2-Z_1-Z_2-Z_3-Z_4$, $Z_1-Z_2-Z_3-X_1-X_2-X_3-X_4-Y_1-Y_2-Z_1-Z_2-Z_3-Z_4$, $Z_1-Z_2-Z_3-X_1-X_2-Y_1-Y_2-Y_3-Z_1-Z_2-Z_3-Z_4$, $Z_1-Z_2-Z_3-X_1-X_2-X_3-Y_1-Y_2-Y_3-Z_1-Z_2-Z_3-Z_4$, $Z_1-Z_2-Z_3-X_1-X_2-X_3-X_4-Y_1-Y_2-Y_3-Z_1-Z_2-Z_3-Z_4$, $Z_1-Z_2-Z_3-X_1-X_2-Y_1-Y_2-Y_3-Y_4-Z_1-Z_2-Z_3-Z_4$, $Z_1-Z_2-Z_3-X_1-X_2-X_3-Y_1-Y_2-Y_3-Y_4-Z_1-Z_2-Z_3-Z_4$, $Z_1-Z_2-Z_3-X_1-X_2-X_3-X_4-Y_1-Y_2-Y_3-Y_4-Z_1-Z_2-Z_3-Z_4$, $Z_1-Z_2-Z_3-Z_4-X_1-X_2-Y_1-Y_2-Z_1-Z_2-Z_3-Z_4$, $Z_1-Z_2-Z_3-Z_4-X_1-X_2-X_3-Y_1-Y_2-Z_1-Z_2-Z_3-Z_4$, $Z_1-Z_2-Z_3-Z_4-X_1-X_2-X_3-X_4-Y_1-Y_2-Z_1-Z_2-Z_3-Z_4$, $Z_1-Z_2-Z_3-Z_4-X_1-X_2-Y_1-Y_2-Y_3-Z_1-Z_2-Z_3-Z_4$, $Z_1-Z_2-Z_3-Z_4-X_1-X_2-X_3-Y_1-Y_2-Y_3-Z_1-Z_2-Z_3-Z_4$, $Z_1-Z_2-Z_3-Z_4-X_1-X_2-X_3-X_4-Y_1-Y_2-Y_3-Z_1-Z_2-Z_3-Z_4$, $Z_1-Z_2-Z_3-Z_4-X_1-X_2-Y_1-Y_2-Y_3-Y_4-Z_1-Z_2-Z_3-Z_4$, $Z_1-Z_2-Z_3-Z_4-X_1-X_2-X_3-Y_1-Y_2-Y_3-Y_4-Z_1-Z_2-Z_3-Z_4$, $Z_1-Z_2-Z_3-Z_4-X_1-X_2-X_3-X_4-Y_1-Y_2-Y_3-Y_4-Z_1-Z_2-Z_3-Z_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Z_1-Y_1-Y_2-X_1-X_2-Z_1$, $Z_1-Y_1-Y_2-X_1-X_2-X_3-Z_1$, $Z_1-Y_1-Y_2-X_1-X_2-X_3-X_4-Z_1$, $Z_1-Y_1-Y_2-Y_3-X_1-X_2-Z_1$, $Z_1-Y_1-Y_2-Y_3-X_1-X_2-X_3-Z_1$, $Z_1-Y_1-Y_2-Y_3-X_1-X_2-X_3-X_4-Z_1$, $Z_1-Y_1-Y_2-Y_3-Y_4-X_1-X_2-Z_1$, $Z_1-Y_1-Y_2-Y_3-Y_4-X_1-X_2-X_3-Z_1$, $Z_1-Y_1-Y_2-Y_3-Y_4-X_1-X_2-X_3-X_4-Z_1$, $Z_1-Z_2-Y_1-Y_2-X_1-X_2-Z_1$, $Z_1-Z_2-Y_1-Y_2-X_1-X_2-X_3-Z_1$, $Z_1-Z_2-Y_1-Y_2-X_1-X_2-X_3-X_4-Z_1$, $Z_1-Z_2-Y_1-Y_2-Y_3-X_1-X_2-Z_1$, $Z_1-Z_2-Y_1-Y_2-Y_3-X_1-X_2-X_3-Z_1$, $Z_1-Z_2-Y_1-Y_2-Y_3-X_1-X_2-X_3-X_4-Z_1$, $Z_1-Z_2-Y_1-Y_2-Y_3-Y_4-X_1-X_2-Z_1$, $Z_1-Z_2-Y_1-Y_2-Y_3-Y_4-X_1-X_2-X_3-Z_1$, $Z_1-Z_2-Y_1-Y_2-Y_3-Y_4-X_1-X_2-X_3-X_4-Z_1$, $Z_1-Z_2-Z_3-Y_1-Y_2-X_1-X_2-Z_1$, $Z_1-Z_2-Z_3-Y_1-Y_2-X_1-X_2-X_3-Z_1$, $Z_1-Z_2-Z_3-Y_1-Y_2-X_1-X_2-X_3-X_4-Z_1$, $Z_1-Z_2-Z_3-Y_1-Y_2-Y_3-X_1-X_2-Z_1$, $Z_1-Z_2-Z_3-Y_1-Y_2-Y_3-X_1-X_2-X_3-Z_1$, $Z_1-Z_2-Z_3-Y_1-Y_2-Y_3-X_1-X_2-X_3-X_4-Z_1$, $Z_1-Z_2-Z_3-Y_1-Y_2-Y_3-Y_4-X_1-X_2-Z_1$, $Z_1-Z_2-Z_3-Y_1-Y_2-Y_3-Y_4-X_1-X_2-X_3-Z_1$, $Z_1-Z_2-Z_3-Y_1-Y_2-Y_3-Y_4-X_1-X_2-X_3-X_4-Z_1$, $Z_1-Z_2-Z_3-Z_4-Y_1-Y_2-X_1-X_2-Z_1$, $Z_1-Z_2-Z_3-Z_4-Y_1-Y_2-X_1-X_2-X_3-Z_1$, $Z_1-Z_2-Z_3-Z_4-Y_1-Y_2-X_1-X_2-X_3-X_4-Z_1$, $Z_1-Z_2-Z_3-Z_4-Y_1-Y_2-Y_3-X_1-X_2-Z_1$, $Z_1-Z_2-Z_3-Z_4-Y_1-Y_2-Y_3-X_1-X_2-X_3-Z_1$, $Z_1-Z_2-Z_3-Z_4-Y_1-Y_2-Y_3-X_1-X_2-X_3-X_4-Z_1$, $Z_1-Z_2-Z_3-Z_4-Y_1-Y_2-Y_3-Y_4-X_1-X_2-Z_1$, $Z_1-Z_2-Z_3-Z_4-Y_1-Y_2-Y_3-Y_4-X_1-X_2-X_3-Z_1$, $Z_1-Z_2-Z_3-Z_4-Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Z_1-Y_1-Y_2-X_1-X_2-Z_1-Z_2$, $Z_1-Y_1-Y_2-X_1-X_2-X_3-Z_1-Z_2$, $Z_1-Y_1-Y_2-X_1-X_2-X_3-X_4-Z_1-Z_2$, $Z_1-Y_1-Y_2-Y_3-X_1-X_2-Z_1-Z_2$, $Z_1-Y_1-Y_2-Y_3-X_1-X_2-X_3-Z_1-Z_2$, $Z_1-Y_1-Y_2-Y_3-X_1-X_2-X_3-X_4-Z_1-Z_2$, $Z_1-Y_1-Y_2-Y_3-Y_4-X_1-X_2-Z_1-Z_2$, $Z_1-Y_1-Y_2-Y_3-Y_4-X_1-X_2-X_3-Z_1-Z_2$, $Z_1-Y_1-Y_2-Y_3-Y_4-X_1-X_2-X_3-X_4-Z_1-Z_2$, $Z_1-Z_2-Y_1-Y_2-X_1-X_2-Z_1-Z_2$, $Z_1-Z_2-Y_1-Y_2-X_1-X_2-X_3-Z_1-Z_2$, $Z_1-Z_2-Y_1-Y_2-X_1-X_2-X_3-X_4-Z_1-Z_2$, $Z_1-Z_2-Y_1-Y_2-Y_3-X_1-X_2-Z_1-Z_2$, $Z_1-Z_2-Y_1-Y_2-Y_3-X_1-X_2-X_3-Z_1-Z_2$, $Z_1-Z_2-Y_1-Y_2-Y_3-X_1-X_2-X_3-X_4-Z_1-Z_2$, $Z_1-Z_2-Y_1-Y_2-Y_3-Y_4-X_1-X_2-Z_1-Z_2$, $Z_1-Z_2-Y_1-Y_2-Y_3-Y_4-X_1-X_2-X_3-Z_1-Z_2$, $Z_1-Z_2-Y_1-Y_2-Y_3-Y_4-X_1-X_2-X_3-X_4-Z_1-Z_2$, $Z_1-Z_2-Z_3-Y_1-Y_2-X_1-X_2-Z_1-Z_2$, $Z_1-Z_2-Z_3-Y_1-Y_2-X_1-X_2-X_3-Z_1-Z_2$, $Z_1-Z_2-Z_3-Y_1-Y_2-X_1-X_2-X_3-X_4-Z_1-Z_2$, $Z_1-Z_2-Z_3-Y_1-Y_2-Y_3-X_1-X_2-Z_1-Z_2$, $Z_1-Z_2-Z_3-Y_1-Y_2-Y_3$-xi-$X_2-X_3-Z_1-Z_2$, $Z_1-Z_2-Z_3-Y_1-Y_2-Y_3-X_1-X_2-X_3-X_4-Z_1-Z_2$, $Z_1-Z_2-Z_3-Y_1-Y_2-Y_3-Y_4-X_1-X_2-Z_1-Z_2$, $Z_1-Z_2-Z_3-Y_1-Y_2-Y_3-Y_4-X_1-X_2-X_3-Z_1-Z_2$, $Z_1-Z_2-Z_3-Y_1-Y_2-Y_3-Y_4-X_1-X_2-X_3-X_4-Z_1-Z_2$, $Z_1-Z_2-Z_3-Z_4-Y_1-Y_2-X_1-X_2-Z_1-Z_2$, $Z_1-Z_2-Z_3-Z_4-Y_1-Y_2-X_1-X_2-X_3-Z_1-Z_2$, $Z_1-Z_2-Z_3-Z_4-Y_1-Y_2-X_1-X_2-X_3-X_4-Z_1-Z_2$, $Z_1-Z_2-Z_3-Z_4-Y_1-Y_2-Y_3-X_1-X_2-Z_1-Z_2$, $Z_1-Z_2-Z_3-Z_4-Y_1-Y_2-Y_3-X_1-X_2-X_3-Z_1-Z_2$, $Z_1-Z_2-Z_3-Z_4-Y_1-Y_2-Y_3-X_1-X_2-X_3-X_4-Z_1-Z_2$, $Z_1-Z_2-Z_3-Z_4-Y_1-Y_2-Y_3-Y_4-X_1-X_2-Z_1-Z_2$, $Z_1-Z_2-Z_3-Z_4-Y_1-Y_2-Y_3-Y_4-X_1-X_2-X_3-Z_1-Z_2$, $Z_1-Z_2-Z_3-Z_4-Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Z_1-Y_1-Y_2-X_1-X_2-Z_1-Z_2-Z_3$, $Z_1-Y_1-Y_2-X_1-X_2-X_3-Z_1-Z_2-Z_3$, $Z_1-Y_1-Y_2-X_1-X_2-X_3-X_4-Z_1-Z_2-Z_3$, $Z_1-Y_1-Y_2-Y_3-X_1-X_2-Z_1-Z_2-Z_3$, $Z_1-Y_1-Y_2-Y_3-X_1-X_2-X_3-Z_1-Z_2-Z_3$, $Z_1-Y_1-Y_2-Y_3-X_1-X_2-X_3-X_4-Z_1-Z_2-Z_3$, $Z_1-Y_1-Y_2-Y_3-Y_4-X_1-X_2-Z_1-Z_2-Z_3$, $Z_1-Y_1-Y_2-Y_3-Y_4-X_1-X_2-X_3-Z_1-Z_2-Z_3$, $Z_1-Y_1-Y_2-Y_3-Y_4-X_1-X_2-X_3-X_4-Z_1-Z_2-Z_3$, $Z_1-Z_2-Y_1-Y_2-X_1-X_2-Z_1-Z_2-Z_3$, $Z_1-Z_2-Y_1-Y_2-X_1-X_2-X_3-Z_1-Z_2-Z_3$, $Z_1-Z_2-Y_1-Y_2-X_1-X_2-X_3-X_4-Z_1-Z_2-Z_3$, $Z_1-Z_2-Y_1-Y_2-Y_3-X_1-X_2-Z_1-Z_2-Z_3$, $Z_1-Z_2-Y_1-Y_2-Y_3-X_1-X_2-X_3-Z_1-Z_2-Z_3$, $Z_1-Z_2-Y_1-Y_2-Y_3-X_1-X_2-X_3-X_4-Z_1-Z_2-Z_3$, $Z_1-Z_2-Y_1-Y_2-Y_3-Y_4-X_1-X_2-Z_1-Z_2-Z_3$, $Z_1-Z_2-Y_1-Y_2-Y_3-Y_4-X_1-X_2-X_3-Z_1-Z_2-Z_3$, $Z_1-Z_2-Y_1-Y_2-Y_3-Y_4-X_1-X_2-X_3-X_4-Z_1-Z_2-Z_3$, $Z_1-Z_2-Z_3-Y_1-Y_2-X_1-X_2-Z_1-Z_2-Z_3$, $Z_1-Z_2-Z_3-Y_1-Y_2-X_1-X_2-X_3-Z_1-Z_2-Z_3$, $Z_1-Z_2-Z_3-Y_1-Y_2-X_1-X_2-X_3-X_4-Z_1-Z_2-Z_3$, $Z_1-Z_2-Z_3-Y_1-Y_2-Y_3-X_1-X_2-Z_1-Z_2-Z_3$, $Z_1-Z_2-Z_3-Y_1-Y_2-Y_3-X_1-X_2-X_3-Z_1-Z_2-Z_3$, $Z_1-Z_2-Z_3-Y_1-Y_2-Y_3-X_1-X_2-X_3-X_4-Z_1-Z_2-Z_3$, $Z_1-Z_2-Z_3-Y_1-Y_2-Y_3-Y_4-X_1-X_2-Z_1-Z_2-Z_3$, $Z_1-Z_2-Z_3-Y_1-Y_2-Y_3-Y_4-X_1-X_2-X_3-Z_1-Z_2-Z_3$, $Z_1-Z_2-Z_3-Y_1-Y_2-Y_3-Y_4-X_1-X_2-X_3-X_4-Z_1-Z_2-Z_3$, $Z_1-Z_2-Z_3-Z_4-Y_1-Y_2-X_1-X_2-Z_1-Z_2-Z_3$, $Z_1-Z_2-Z_3-Z_4-Y_1-Y_2-X_1-X_2-X_3-Z_1-Z_2-Z_3$, $Z_1-Z_2-Z_3-Z_4-Y_1-Y_2-X_1-X_2-X_3-X_4-Z_1-Z_2-Z_3$, $Z_1-Z_2-Z_3-Z_4-Y_1-Y_2-Y_3-X_1-X_2-Z_1-Z_2-Z_3$, $Z_1-Z_2-Z_3-Z_4-Y_1-Y_2-Y_3-X_1-X_2-X_3-Z_1-Z_2-Z_3$, $Z_1-Z_2-Z_3-Z_4-Y_1-Y_2-Y_3-X_1-X_2-X_3-X_4-Z_1-Z_2-Z_3$, $Z_1-Z_2-Z_3-Z_4-Y_1-Y_2-Y_3-Y_4-X_1-X_2-Z_1-Z_2-Z_3$, $Z_1-Z_2-Z_3-Z_4-Y_1-Y_2-Y_3-Y_4-X_1-X_2-X_3-Z_1-Z_2-Z_3$, $Z_1-Z_2-Z_3-Z_4-Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-$ $X_2$-$X_3$-$Z_1$-$Z_2$-$Z_3$-$Z_4$, $Y_1$-$Y_2$-$X_1$-$X_2$-$X_3$-$X_4$-$Z_1$-$Z_2$-$Z_3$-$Z_4$, $Y_1$-$Y_2$-$Y_3$-$X_1$-$X_2$-$Z_1$-$Z_2$-$Z_3$-$Z_4$, $Y_1$-$Y_2$-$Y_3$-$X_1$-$X_2$-$X_3$-$Z_1$-$Z_2$-$Z_3$-$Z_4$, $Y_1$-$Y_2$-$Y_3$-$X_1$-$X_2$-$X_3$-$X_4$-$Z_1$-$Z_2$-$Z_3$-$Z_4$, $Y_1$-$Y_2$-$Y_3$-$Y_4$-$X_1$-$X_2$-$Z_1$-$Z_2$-$Z_3$-$Z_4$, $Y_1$-$Y_2$-$Y_3$-$Y_4$-$X_1$-$X_2$-$X_3$-$Z_1$-$Z_2$-$Z_3$-$Z_4$, $Y_1$-$Y_2$-$Y_3$-$Y_4$-$X_1$-$X_2$-$X_3$-$X_4$-$Z_1$-$Z_2$-$Z_3$-$Z_4$, $Z_1$-$Y_1$-$Y_2$-$X_1$-$X_2$-$Z_1$-$Z_2$-$Z_3$-$Z_4$, $Z_1$-$Y_1$-$Y_2$-$X_1$-$X_2$-$X_3$-$Z_1$-$Z_2$-$Z_3$-$Z_4$, $Z_1$-$Y_1$-$Y_2$-$X_1$-$X_2$-$X_3$-$X_4$-$Z_1$-$Z_2$-$Z_3$-$Z_4$, $Z_1$-$Y_1$-$Y_2$-$Y_3$-$X_1$-$X_2$-$Z_1$-$Z_2$-$Z_3$-$Z_4$, $Z_1$-$Y_1$-$Y_2$-$Y_3$-$X_1$- $X_2$-$X_3$-$Z_1$-$Z_2$-$Z_3$-$Z_4$, $Z_1$-$Y_1$-$Y_2$-$Y_3$-$X_1$-$X_2$-$X_3$-$X_4$-$Z_1$-$Z_2$-$Z_3$-$Z_4$, $Z_1$-$Y_1$-$Y_2$-$Y_3$-$Y_4$-$X_1$-$X_2$-$Z_1$-$Z_2$-$Z_3$-$Z_4$, $Z_1$-$Y_1$-$Y_2$-$Y_3$-$Y_4$-$X_1$-$X_2$-$X_3$-$Z_1$-$Z_2$-$Z_3$-$Z_4$, $Z_1$-$Y_1$-$Y_2$-$Y_3$-$Y_4$-$X_1$-$X_2$-$X_3$-$X_4$-$Z_1$-$Z_2$-$Z_3$-$Z_4$, $Z_1$-$Z_2$-$Y_1$-$Y_2$-$X_1$-$X_2$-$Z_1$-$Z_2$-$Z_3$-$Z_4$, $Z_1$-$Z_2$-$Y_1$-$Y_2$-$X_1$-$X_2$-$X_3$-$Z_1$-$Z_2$-$Z_3$-$Z_4$, $Z_1$-$Z_2$-$Y_1$-$Y_2$-$X_1$-$X_2$-$X_3$-$X_4$-$Z_1$-$Z_2$-$Z_3$-$Z_4$, $Z_1$-$Z_2$-$Y_1$-$Y_2$-$Y_3$-$X_1$-$X_2$-$Z_1$-$Z_2$-$Z_3$-$Z_4$, $Z_1$-$Z_2$-$Y_1$-$Y_2$-$Y_3$-$X_1$-$X_2$-$X_3$-$Z_1$-$Z_2$-$Z_3$-$Z_4$, $Z_1$-$Z_2$-$Y_1$-$Y_2$-$Y_3$-$X_1$-$X_2$-$X_3$-$X_4$-$Z_1$-$Z_2$-$Z_3$-$Z_4$, $Z_1$-$Z_2$-$Y_1$-$Y_2$-$Y_3$-$Y_4$-$X_1$-$X_2$-$Z_1$-$Z_2$-$Z_3$-$Z_4$, $Z_1$-$Z_2$-$Y_1$-$Y_2$-$Y_3$-$Y_4$-$X_1$-$X_2$-$X_3$-$Z_1$-$Z_2$-$Z_3$-$Z_4$, $Z_1$-$Z_2$-$Y_1$-$Y_2$-$Y_3$-$Y_4$-$X_1$-$X_2$-$X_3$-$X_4$-$Z_1$-$Z_2$-$Z_3$-$Z_4$, $Z_1$-$Z_2$-$Z_3$-$Y_1$-$Y_2$-$X_1$-$X_2$-$Z_1$-$Z_2$-$Z_3$-$Z_4$, $Z_1$-$Z_2$-$Z_3$-$Y_1$-$Y_2$-$X_1$-$X_2$-$X_3$-$Z_1$-$Z_2$-$Z_3$-$Z_4$, $Z_1$-$Z_2$-$Z_3$-$Y_1$-$Y_2$-$X_1$-$X_2$-$X_3$-$X_4$-$Z_1$-$Z_2$-$Z_3$-$Z_4$, $Z_1$-$Z_2$-$Z_3$-$Y_1$-$Y_2$-$Y_3$-$X_1$-$X_2$-$Z_1$-$Z_2$-$Z_3$-$Z_4$, $Z_1$-$Z_2$-$Z_3$-$Y_1$-$Y_2$-$Y_3$-$X_1$-$X_2$-$X_3$-$Z_1$-$Z_2$-$Z_3$-$Z_4$, $Z_1$-$Z_2$-$Z_3$-$Y_1$-$Y_2$-$Y_3$-$X_1$-$X_2$-$X_3$-$X_4$-$Z_1$-$Z_2$-$Z_3$-$Z_4$, $Z_1$-$Z_2$-$Z_3$-$Y_1$-$Y_2$-$Y_3$-$Y_4$-$X_1$-$X_2$-$Z_1$-$Z_2$-$Z_3$-$Z_4$, $Z_1$-$Z_2$-$Z_3$-$Y_1$-$Y_2$-$Y_3$-$Y_4$-$X_1$-$X_2$-$X_3$-$Z_1$-$Z_2$-$Z_3$-$Z_4$, $Z_1$-$Z_2$-$Z_3$-$Y_1$-$Y_2$-$Y_3$-$Y_4$-$X_1$-$X_2$-$X_3$-$X_4$-$Z_1$-$Z_2$-$Z_3$-$Z_4$, $Z_1$-$Z_2$-$Z_3$-$Z_4$-$Y_1$-$Y_2$-$X_1$-$X_2$-$Z_1$-$Z_2$-$Z_3$-$Z_4$, $Z_1$-$Z_2$-$Z_3$-$Z_4$-$Y_1$-$Y_2$-$X_1$-$X_2$-$X_3$-$Z_1$-$Z_2$-$Z_3$-$Z_4$, $Z_1$-$Z_2$-$Z_3$-$Z_4$-$Y_1$-$Y_2$-$X_1$-$X_2$-$X_3$-$X_4$-$Z_1$-$Z_2$-$Z_3$-$Z_4$, $Z_1$-$Z_2$-$Z_3$-$Z_4$-$Y_1$-$Y_2$-$Y_3$-$X_1$-$X_2$-$Z_1$-$Z_2$-$Z_3$-$Z_4$, $Z_1$-$Z_2$-$Z_3$-$Z_4$-$Y_1$-$Y_2$-$Y_3$-$X_1$-$X_2$-$X_3$-$Z_1$-$Z_2$-$Z_3$-$Z_4$, $Z_1$-$Z_2$-$Z_3$-$Z_4$-$Y_1$-$Y_2$-$Y_3$-$X_1$-$X_2$-$X_3$-$X_4$-$Z_1$-$Z_2$-$Z_3$-$Z_4$, $Z_1$-$Z_2$-$Z_3$-$Z_4$-$Y_1$-$Y_2$-$Y_3$-$Y_4$-$X_1$-$X_2$-$Z_1$-$Z_2$-$Z_3$-$Z_4$, $Z_1$-$Z_2$-$Z_3$-$Z_4$-$Y_1$-$Y_2$-$Y_3$-$Y_4$-$X_1$-$X_2$-$X_3$-$Z_1$-$Z_2$-$Z_3$-$Z_4$, $Z_1$-$Z_2$-$Z_3$-$Z_4$-$Y_1$-$Y_2$-$Y_3$-$Y_4$-$X_1$-$X_2$-$X_3$-$X_4$-$Z_1$-$Z_2$-$Z_3$-$Z_4$, wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

In related embodiments, cleavable binary linker peptides (L) comprising an X region and a Y region are described above, and exemplary Z regions (1-4 amino acid sequences, for example, 2 amino acid sequences) that may be fused in frame to the X and/or Y regions (either to the N-terminal sequence of an X or Y region, or the C-terminal sequence of an X or Y region) described above form the tertiary cleavable linking peptides. Illustrative Z or spacer amino acid sequences may include: AA, AF, AM, AN, AQ, AV, AW, AY, DA, DD, DE, DF, DG, DI, DL, DP, DS, DT, DV, DW, DY, EA, ED, EE, EF, EG, EI, EL, EP, ES, ET, EV, EW, EY, FA, FD, FE, FF, FI, FK, FL, FM, FN, FQ, FR, FS, FT, FV, FW, FY, GA, GD, GE, GF, GI, GL, GM, GN, GQ, GS, GV, GW, GY, HA, HD, HE, HF, HH, HI, HK, HL, FIN, HP, HQ, HR, HS, HT, HV, HY, IA, ID, IE, IG, IH, II, IK, IL, IM, IN, IP, IQ, IR, IS, IT, IV, IW, KA, KD, KE, KF, KI, KL, KN, KQ, KV, KY, LA, LD, LE, LG, LH, LI, LK, LL, LM, LN, LP, LQ, LR, LS, LT, LV, LW, MA, MF, MG, MI, MK, ML, MM, MN, MQ, MR, MS, MT, MV, MY, NA, ND, NE, NF, NI, NL, NM, NN, NQ, NS, NT, NV, NY, QA, QD, QE, QF, QI, QL, QM, QN, QQ, QS, QT, QV, QY, RA, RD, RE, RF, RI, RL, RN, RQ, RV, RY, SA, SF, SG, SK, SN, SP, SQ, SR, SS, ST, SV, SW, SY, TA, TF, TG, TK, TN, TP, TQ, TR, TS, TT, TV, TW, TY, VA, VF, VM, VN, VQ, VV, VW, VY, WA, WF, WI, WK, WL, WN, WP, WQ, WR, WS, WT, WV, WW, WY, YA, YD, YE, YF, YI, YK, YL, YM, YN, YQ, YR, YS, YT, YV, YW, or YY.

In exemplary embodiments, individual tertiary peptides of the present invention can include a two amino acid sequence, fused in frame to the N-terminus and/or the C-terminus of an illustrative binary peptide disclosed above, wherein the two amino acid sequence is AM, LH, MN, ES, WQ, or DT.

In exemplary embodiments, individual tertiary peptides of the present invention can include a two amino acid sequence, fused in frame to the N-terminus and/or the C-terminus of an illustrative binary peptide disclosed above, wherein the two amino acid sequence is GS, WN, WQ, MA or MV.

In some embodiments, the spacer portion of the tertiary peptide (Z region) comprises the amino acid sequence GS, which may be fused in frame to the N-terminus or C-terminus of the binary peptide or both.

In various embodiments, exemplary binary peptides for use in the insecticidal and/or nematicidal polypeptides and proteins, DNA constructs and polynucleotides encoding an insecticidal and/or nematicidal polypeptide and protein and incorporated into a transgenic plants or part thereof, of the present invention, may include one or more cleavable tertiary peptides selected from the group of or consisting of: a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini with a Z region or spacer sequence selected from the group of or consisting of GS, WN, WQ, MA, MV, AM, LH, MN, ES, WQ, or DT.

In some embodiments, an exemplary DNA construct may encode an insecticidal and/or nematicidal protein comprising a cleavable tertiary peptide having one or more of the following illustrative amino acid sequences (ZXY or XYZ): AFVRLFGS (SEQ ID NO: 1649), AKLFVGS (SEQ ID NO: 1650), ALFALKGS (SEQ ID NO: 1651), ALFLKGS (SEQ ID NO: 1652), ALFLRGS (SEQ ID NO: 1653), ALFRGS (SEQ ID NO: 1654), ALFRLRGS (SEQ ID NO: 1655), ALKALFGS (SEQ ID NO: 1656), ALKFFGS (SEQ ID NO: 1657), ALKFLVGS (SEQ ID NO: 1658), ALKIFVGS (SEQ ID NO: 1659), ALKLFVGS (SEQ ID NO: 1660), FFADIKGS (SEQ ID NO: 1661), FFALKGS (SEQ ID NO: 1662), FFLKGS (SEQ ID NO: 1663), FFLRGS (SEQ ID NO: 1664), FFRLRGS (SEQ ID NO: 1665), FGYRIKGS (SEQ ID NO: 1666), FLRLFGS (SEQ ID NO: 1667), FYARRGS (SEQ ID NO: 1668), GGLRKKGS (SEQ ID NO: 1669), IFVALKGS (SEQ ID NO: 1670), IFVLKGS (SEQ ID NO: 1671), IFVLRGS (SEQ ID NO: 1672), IFVRGS (SEQ ID NO: 1673), IFVRLRGS (SEQ ID NO: 1674), ILFNIKGS (SEQ ID NO: 1675), LFAAPFGS (SEQ ID NO: 1676), LFVALKGS (SEQ ID NO: 1677), LFVLKGS (SEQ ID NO: 1678), LFVLRGS (SEQ ID NO: 1679), LFVRGS (SEQ ID NO: 1680), LFVRLRGS (SEQ ID NO: 1681), LFVRVFLGS (SEQ ID NO: 1682), LGERGS (SEQ ID NO: 1683), LKALFGS (SEQ ID NO: 1684), LKFFGS (SEQ ID NO: 1685), LKIFVGS (SEQ ID NO: 1686), LKLFVGS (SEQ ID NO: 1687), LRALFGS (SEQ ID NO: 1688), LRFFGS (SEQ ID NO: 1689), LRIFVGS (SEQ ID NO: 1690), LRLFVGS (SEQ ID NO: 1691), RALFGS (SEQ ID NO: 1692), RIFVGS (SEQ ID NO: 1693), RLFVGS (SEQ ID NO: 1694), RLRALFGS (SEQ ID NO: 1695), RLRFFGS (SEQ ID NO: 1696), RLRIFVGS (SEQ ID NO: 1697), RLRLFVGS (SEQ ID NO: 1698), RRKAFVGS (SEQ ID NO: 1699), RRKLIFGS (SEQ ID NO: 1700), RRRFFAGS (SEQ ID NO: 1701), VFGRKGGS (SEQ ID NO: 1702), YFVRKGS (SEQ ID NO: 1703), GSAFVRLF (SEQ ID NO: 1704), GSAKLFV (SEQ ID NO: 1705), GSALFALK (SEQ ID NO: 1706), GSALFLK (SEQ ID NO: 1707), GSALFLR (SEQ ID NO: 1708), GSALFR (SEQ ID NO: 1709), GSALFRLR (SEQ ID NO: 1710), GSALKALF (SEQ ID NO: 1711), GSALKFF (SEQ ID NO: 1712), GSALKFLV (SEQ ID NO: 1713), GSALKIFV (SEQ ID NO: 1714), GSALKLFV (SEQ ID NO: 1715), GSFFADIK (SEQ ID NO: 1716), GSFFALK (SEQ ID NO: 1717), GSFFLK (SEQ ID NO: 1718), GSFFLR (SEQ ID NO: 1719), GSFFRLR (SEQ ID NO: 1720), GSFGYRIK (SEQ ID NO: 1721), GSFLRLF (SEQ ID NO: 1722), GSFYARR (SEQ ID NO: 1723), GSGGLRKK (SEQ ID NO: 1724), GSIFVALK (SEQ ID NO: 1725), GSIFVLK (SEQ ID NO: 1726), GSIFVLR (SEQ ID NO: 1727), GSIFVR (SEQ ID NO: 1728), GSIFVRLR (SEQ ID NO: 1729), GSILFNIK (SEQ ID NO: 1730), GSLFAAPF (SEQ ID NO: 1731), GSLFVALK (SEQ ID NO: 1732), GSLFVLK (SEQ ID NO: 1733), GSLFVLR (SEQ ID NO: 1734), GSLFVR (SEQ ID NO: 1735), GSLFVRLR (SEQ ID NO: 1736), GSLFVRVFL (SEQ ID NO: 1737), GSLGER (SEQ ID NO: 1738), GSLKALF (SEQ ID NO: 1739), GSLKFF (SEQ ID NO: 1740), GSLKIFV (SEQ ID NO: 1741), GSLKLFV (SEQ ID NO: 1742), GSLRALF (SEQ ID NO: 1743), GSLRFF (SEQ ID NO: 1744), GSLRIFV (SEQ ID NO: 1745), GSLRLFV (SEQ ID NO: 1746), GSRALF (SEQ ID NO: 1747), GSRIFV (SEQ ID NO: 1748), GSRLFV (SEQ ID NO: 1749), GSRLRALF (SEQ ID NO: 1750), GSRLRFF (SEQ ID NO: 1751), GSRLRIFV (SEQ ID NO: 1752), GSRLRLFV (SEQ ID NO: 1753), GSRRKAFV (SEQ ID NO: 1754), GSRRKLIF (SEQ ID NO: 1755), GSRRRFFA (SEQ ID NO: 1756), GSVFGRKG (SEQ ID NO: 1757), and GSYFVRK (SEQ ID NO: 1758).

In various embodiments, the DNA construct comprises a polynucleotide that encodes a tertiary peptide having the amino acid sequence of a binary peptide with the addition of a spacer to the N-terminus of the binary peptide, and/or to the C-terminus of the binary peptide, wherein the spacer is an amino acid or peptide comprising 1 to 4 amino acids, preferably two amino acids, for example GS, WN, WQ, MA, or MV. Other specific spacer examples and optimal amino acids for use as spacers are provided below.

In some embodiments, an exemplary DNA construct encoding an insecticidal and/or nematicidal protein comprises one or more polynucleotides which in combination or singly encode one or more binary peptides comprising the amino acid sequence: IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621) fused in frame at the N-terminal and/or the C-terminal with one or more spacer sequences selected from the amino acid sequences: GS, WN, WQ, MA, MV, AM, LH, MN, ES, WQ, and DT. In various embodiments, an exemplary DNA construct for use in transforming or transfecting a eukaryotic cell, for example, a yeast cell, or a plant cell comprises a polynucleotide that encodes an insecticidal and/or nematicidal protein that includes one or more cleavable tertiary peptides selected from the group of or consisting of: a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini with a Z region or spacer sequence selected from the group of or consisting of GS, WN, WQ, MA, MV, AM, LH, MN, ES, WQ, or DT and one or more TPs as described herein, for example, a CRIP TP, for example, an ICK TP or a non-ICK CRIP TP, a TMOF TP, or a Bt TP as exemplified throughout the present disclosure. In related embodiments, the one or more binary or tertiary peptides (designated linker L) described above are fused in frame with a TP, and optionally, an ERSP and/or optionally a STA, for example, (from N-terminus to C-terminus): (L-TP)$_n$-L, or (L-TP-L)$_n$, (ERSP)-(STA)-(L-TP)$_n$, or (ERSP)-(STA)-(L-TP)$_n$-(L), or (ERSP)-(STA)-(TP-L)$_n$, or (ERSP)-(STA)-(L)-(TP-L)$_n$, or (STA)-(L-TP)$_n$, or (STA)-(L-TP)$_n$-(L), or (STA)-(TP-L)$_n$, or (STA)-(L)-(TP-L)$_n$, wherein n is 1 to 200, for example, from 1-100, or from 1-20, or from 1-10. In embodiments related to the above, the insecticidal and/or nematicidal protein encoded by the one or more polynucleotides may contain TPs that are the same or different, and binary and/or tertiary peptides that are the same or different. In related embodiments of the above, tertiary peptides (designated above as L), may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT, wherein the TPs, if more than one, may be the same or different, and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In various embodiments, the DNA construct of the present invention encodes an insecticidal and/or nematicidal TP that contains one or more binary and/or tertiary peptides as described herein. The one or more binary and/or tertiary peptides are cleavable linking units that can be cleaved in both an animal gut environment, for example a human gut through the action of a human digestive protease, and also in the gut environment of an insect or nematode. The various proteases available in the gut of an animal, for example a human gut, and an insect or nematode are provided herein. In some embodiments, the DNA construct of the present invention encodes an insecticidal and/or nematicidal TP that contains one or more binary and/or tertiary peptides which are cleavable in the gut of a Lepidoptera or a Coleoptera insect species. The same DNA constructs which encode a binary and/or tertiary peptide which is cleavable in the gut of a Lepidoptera or a Coleoptera insect species is also cleavable in a human gut via the action of a human digestive protease.

As disclosed herein DNA constructs are also provided that comprise a polynucleotide that encodes a cleavable binary and/or tertiary peptide fused in frame to a TP, which when in the presence of an appropriate gut protease is released from the encoded binary and/or tertiary peptide, and provides insecticidal and/or nematicidal activity in the intended target insect or nematode. In various embodiments, the TP can be a class of TPs commonly referred to as CRIP peptides, ICK TPs, non-ICK TPs, e.g. sea anemone peptides, TMOF peptides and Bt proteins. In some embodiments, the TP is a protein selected from the group consisting of a Pore Forming Insecticidal Protein (PFIP) and a Cysteine Rich Insecticidal Protein (CRIP). The compositions and methods of the present invention can utilize any amino acid polymer based TP, including those described in International PCT Application Serial No. PCT/US2013/030042 filed on Mar. 8, 2013, the contents of the disclosure are incorporated by reference herein in its entirety.

The present invention also relates to nucleic acid constructs comprising a polynucleotide encoding an insecticidal and/or nematicidal protein comprising at least one cleavable linker and one TP. IN some embodiments, the nucleic acid construct can be a DNA nucleic acid construct or an RNA nucleic acid construct. In some embodiments of the present invention, a nucleic acid construct can include at least one coding sequence operable to encode at least one insecticidal and/or nematicidal protein operably linked to one or more control sequences that direct the expression of the coding sequence in a suitable host cell under conditions compatible with the control sequences. The term “operably linked” means a configuration in which a control sequence is placed at an appropriate position relative to the coding sequence of a polynucleotide such that the control sequence directs expression of the coding sequence.

The polynucleotide may be manipulated in a variety of ways to provide for expression of an insecticidal and/or nematicidal protein. Manipulation of the polynucleotide prior to its insertion into a vector may be desirable or necessary depending on the expression vector. The techniques for modifying polynucleotides utilizing recombinant DNA methods are well known in the art.

The control sequence may be or include a promoter, a polynucleotide which is recognized by a host cell for expression of the polynucleotide. The promoter contains transcriptional control sequences that mediate the expression of the insecticidal and/or nematicidal protein. The promoter may be any polynucleotide that shows transcriptional activity in the host cell including mutant, truncated, and hybrid promoters, and may be obtained from genes encoding extracellular or intracellular polypeptides either homologous or heterologous to the host cell.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, Yeast 8:423-488.

The control sequence may also be a transcription terminator, which is recognized by a host cell to terminate transcription. The terminator sequence is operably linked to the 3'-terminus of the polynucleotide encoding the insecticidal and/or nematicidal protein. Any terminator that is functional in the host cell may be used. Preferred terminators for bacterial host cells are obtained from the genes for *Bacillus clausii* alkaline protease (aprH), *Bacillus licheniformis* alpha-amylase (amyL), and *Escherichia coli* ribosomal RNA (rrnB). Preferred terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra. The control sequence may also be an mRNA stabilizer region downstream of a promoter and upstream of the coding sequence of a gene which increases expression of the gene.

The control sequence may also include a leader, a nontranslated region of an mRNA that is important for translation by the host cell. The leader sequence is operably linked to the 5'-terminus of the polynucleotide encoding the insecticidal and/or nematicidal protein. Any leader that is functional in the host cell may be used. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also include a polyadenylation sequence, a sequence operably linked to the 3'-terminus of the insecticidal and/or nematicidal protein-encoding sequence and, when transcribed, is recognized by the host cell as a signal to add polyadenosine residues to transcribed mRNA. Any polyadenylation sequence that is functional in the host cell may be used. Useful polyadenylation sequences for yeast host cells are described by Guo and Sherman, 1995, Mol. Cellular Biol. 15:5983-5990.

It may also be desirable to add regulatory sequences that regulate expression of the insecticidal and/or nematicidal protein relative to the growth of the host cell. Examples of regulatory systems are those that cause expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the insecticidal and/or nematicidal would be operably linked with the regulatory sequence.

Expression Vectors

The present invention also relates to recombinant expression vectors comprising a polynucleotide encoding an insecticidal and/or nematicidal protein of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the insecticidal and/or nematicidal protein at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid. The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome, for example, a plant genome, and replicated together with the chromosome(s) into which it has been integrated. Furthermore, a single vector or plasmid or two or more vectors or plasmids that together contain the total DNA to be introduced into the genome of the host cell, or a transposon, may be used.

The vector preferably contains one or more selectable markers that permit easy selection of transformed, transfected, transduced, or the like cells. A selectable marker is a gene the product of which provides for biocide or viral resistance, resistance to heavy metals, prototrophy to auxotrophs, and the like. Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin or tetracycline resistance. Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof.

The vector preferably contains an element(s) that permits integration of the vector into the host cell's genome or autonomous replication of the vector in the cell independent of the genome. For integration into the host cell genome, the vector may rely on the polynucleotide's sequence encoding the insecticidal and/or nematicidal protein or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication that functions in a cell. The term "origin of replication" or "plasmid replicator" means a polynucleotide that enables a plasmid or vector to replicate in vivo. Examples of bacterial origins of replication are the origins of replication of plasmids pBR322, pUC19, pACYC177, and pACYC184 permitting replication in *E. coli*, and pUB110, pE194, pTA1060, and pAM.beta.1 permitting replication in *Bacillus*. Examples of origins of replication for use in a yeast host cell are the 2 micron origin of replication, ARS1, ARS4, the combination of ARS1 and CEN3, and the combination of ARS4 and CEN6. More than one copy of a polynucleotide of the present invention may be inserted into a host cell to increase production of an insecticidal and/or nematicidal protein. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent. The procedures used to ligate the elements described above to construct the recombinant expression vectors of the present invention are well known to one skilled in the art (see, e.g., Sambrook et al., 1989, supra).

(4B). ERSP Fused to a Binary or Tertiary Peptide Fused in Frame to a Construct $(Tp\text{-}L)_n$ In some embodiments, each insecticidal and/or nematicidal protein can include an ERSP fused to a binary or tertiary peptide which is fused in frame to a construct comprising: $(TP\text{-}L)_n$ wherein TP is a toxic protein, L is a binary or tertiary peptide and n is an integer ranging from 1 to 200. See FIG. 4. In some of these embodiments, the TPs in the insecticidal and/or nematicidal protein may be the same or different.

All of these classes of TPs are described herein and all of these classes may be incorporated into the DNA constructs described herein wherein at least one TP is encoded in frame with at least one binary or tertiary peptide, preferably two or more TPs are flanked in frame by at least one or at least two cleavable binary or tertiary peptides for example: (ERSP)-(L)-TP-(L)-TP, (ERSP)-(L)-TP-(L)-TP-(L), $(L\text{-}TP)_n$-L, $(L\text{-}TP\text{-}L)_n$, (ERSP)-$(TP\text{-}L)_n$, (ERSP)-(L)-$(TP\text{-}L)_n$, (ERSP)-$(L\text{-}TP)_n$, (ERSP)-$(L\text{-}TP)_n$-(L), (ERSP)-(STA)-$(L\text{-}TP)_n$, (ERSP)-(STA)-$(L\text{-}TP)_n$-(L), (ERSP)-(STA)-$(TP\text{-}L)_n$, or (ERSP)-(STA)-(L)-$(TP\text{-}L)_n$, or (STA)-$(L\text{-}TP)_n$, or (STA)-$(L\text{-}TP)_n$-(L), or (STA)-$(TP\text{-}L)_n$, or (STA)-(L)-$(TP\text{-}L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. See FIGS. 4 and 5.

In some embodiments, the present invention provides insecticidal and/or nematicidal proteins and DNA constructs comprising a polynucleotide that encodes an insecticidal and/or nematicidal protein that may comprise one or more binary and/or tertiary peptides and one or more TPs. Each of the binary and/or tertiary peptides may be the same or different and each of the TPs may be the same or different. In some embodiments, the present invention provides insecticidal and/or nematicidal proteins and DNA constructs comprising a polynucleotide that encodes an insecticidal and/or nematicidal protein that may comprise two or more binary and/or tertiary peptides and two or more TPs. Each of the binary and/or tertiary peptides may be the same or different and each of the TPs may be the same or different. In one illustrative embodiment, the present invention provides a DNA construct comprising at least one polynucleotide operably linked to an operable promoter, for example, a homologous or heterologous promoter, wherein the polynucleotide encodes an insecticidal and/or nematicidal protein having one or more TPs and two or more cleavable binary or tertiary peptides. See FIG. 2.

In another related aspect, the present invention provides an insecticidal and/or nematicidal protein, wherein the insecticidal and/or nematicidal protein comprises an ERSP fused in frame with the N-terminus of a binary or tertiary peptide, the binary or tertiary peptide is fused in frame with a construct comprising $(TP-L)_n$ or the insecticidal and/or nematicidal protein comprises an ERSP fused the N-terminus of a binary or tertiary peptide, the binary or tertiary peptide is fused in frame with a construct comprising $(L-TP)_n$.

In related embodiments, DNA constructs described herein at least one TP is encoded in frame with at least one binary or tertiary peptide, preferably two or more TPs are flanked in frame by at least one or at least two cleavable binary or tertiary peptides cleavable binary linker peptides (L) comprising an X region and a Y region are described above, and exemplary Z regions (1-4 amino acid sequences, for example, 2 amino acid sequences) that may be fused in frame to the X and/or Y regions (either to the N-terminal sequence of an X or Y region, or the C-terminal sequence of an X or Y region) described above form the tertiary cleavable linking peptides. Illustrative Z or spacer amino acid sequences may include: AA, AF, AM, AN, AQ, AV, AW, AY, DA, DD, DE, DF, DG, DI, DL, DP, DS, DT, DV, DW, DY, EA, ED, EE, EF, EG, EI, EL, EP, ES, ET, EV, EW, EY, FA, FD, FE, FF, FI, FK, FL, FM, FN, FQ, FR, FS, FT, FV, FW, FY, GA, GD, GE, GF, GI, GL, GM, GN, GQ, GS, GV, GW, GY, HA, HD, HE, HF, HH, HI, HK, HL, FIN, HP, HQ, HR, HS, HT, HV, HY, IA, ID, IE, IG, IH, II, IK, IL, IM, IN, IP, IQ, IR, IS, IT, IV, IW, KA, KD, KE, KF, KI, KL, KN, KQ, KV, KY, LA, LD, LE, LG, LH, LI, LK, LL, LM, LN, LP, LQ, LR, LS, LT, LV, LW, MA, MF, MG, MI, MK, ML, MM, MN, MQ, MR, MS, MT, MV, MY, NA, ND, NE, NF, NI, NL, NM, NN, NQ, NS, NT, NV, NY, QA, QD, QE, QF, QI, QL, QM, QN, QQ, QS, QT, QV, QY, RA, RD, RE, RF, RI, RL, RN, RQ, RV, RY, SA, SF, SG, SK, SN, SP, SQ, SR, SS, ST, SV, SW, SY, TA, TF, TG, TK, TN, TP, TQ, TR, TS, TT, TV, TW, TY, VA, VF, VM, VN, VQ, VV, VW, VY, WA, WF, WI, WK, WL, WN, WP, WQ, WR, WS, WT, WV, WW, WY, YA, YD, YE, YF, YI, YK, YL, YM, YN, YQ, YR, YS, YT, YV, YW, or YY. In exemplary embodiments, individual tertiary peptides of the present invention can include a two amino acid sequence, fused in frame to the N-terminus and/or the C-terminus of an illustrative binary peptide disclosed above, wherein the two amino acid sequence is AM, LH, MN, ES, WQ, or DT.

In exemplary embodiments, individual tertiary peptides of the present invention can include a two amino acid sequence, fused in frame to the N-terminus and/or the C-terminus of an illustrative binary peptide disclosed above, wherein the two amino acid sequence is GS, WN, WQ, MA or MV.

In some embodiments, the spacer portion of the tertiary peptide (Z region) comprises the amino acid sequence GS, which may be fused in frame to the N-terminus or C-terminus of the binary peptide or both.

In various embodiments, exemplary binary peptides for use in the insecticidal and/or nematicidal polypeptides and proteins, DNA constructs and polynucleotides encoding an insecticidal and/or nematicidal polypeptide and protein and incorporated into a transgenic plants or part thereof, of the present invention, may include one or more cleavable tertiary peptides selected from the group of or consisting of: a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini with a Z region or spacer sequence selected from the group of or consisting of GS, WN, WQ, MA, MV, AM, LH, MN, ES, WQ, or DT. In embodiments related to the above, the insecticidal and/or nematicidal protein may contain TPs that are the same or different, and the binary or tertiary peptides may be the same or different. In related embodiments of the above, tertiary peptides (designated above as L), may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT. See FIG. 4. In related embodiments of the above, TPs useful in the manufacture of an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In various embodiments, an exemplary insecticidal and/or nematicidal protein can include: (ERSP)-(L)-TP-(L)-TP, (ERSP)-(L)-TP-(L)-TP-(L), $(L-TP)_n$-L, $(L-TP-L)_n$, (ERSP)-$(TP-L)_n$, (ERSP)-(L)-$(TP-L)_n$, (ERSP)-$(L-TP)_n$, (ERSP)-$(L-TP)_n$-(L), (ERSP)-(STA)-$(L-TP)_n$, (ERSP)-(STA)-$(L-TP)_n$-

Figure 4:
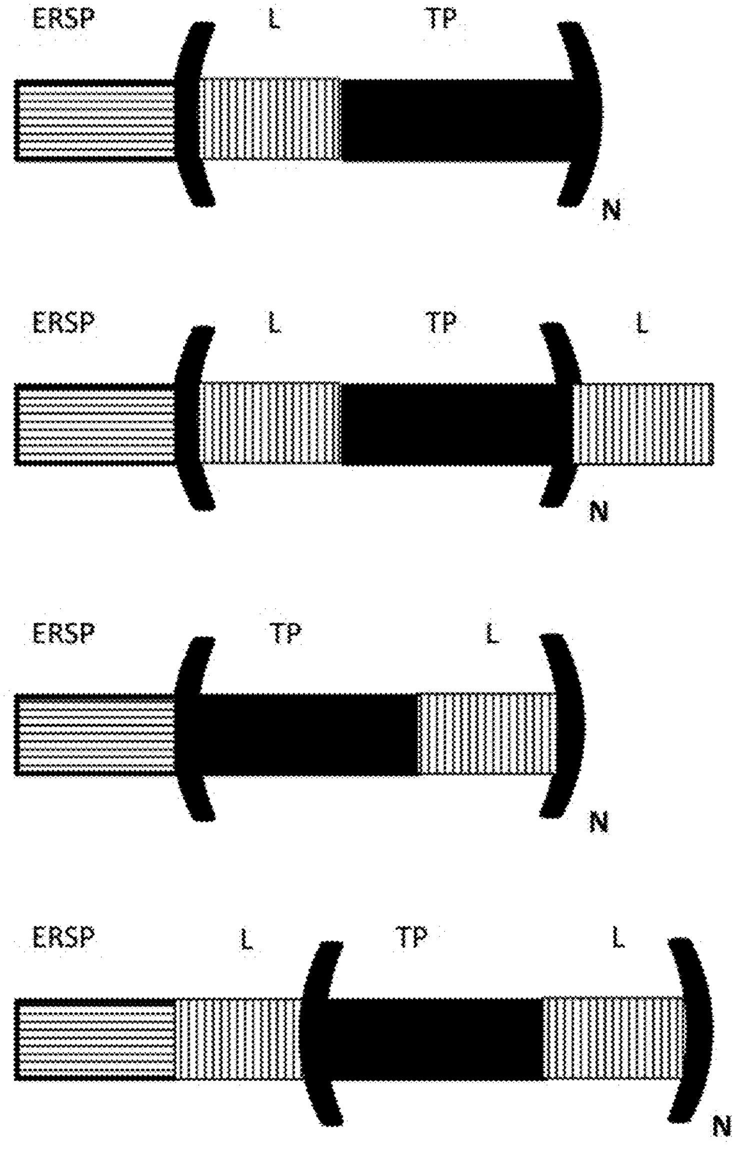
FIG. 4. Demonstration of the Binary or Tertiary Cleavable Linking Peptide in an insecticidal and/or nematicidal protein with two or more TPs and an ERSP. This figure illustrates various embodiments from FIG. 2 with the addition of an N-terminal fusion of an ERSP.

(L), (ERSP)-(STA)-(TP-L)$_n$, or (ERSP)-(STA)-(L)-(TP-L)$_n$, or (STA)-(L-TP)$_n$, or (STA)-(L-TP)$_n$-(L), or (STA)-(TP-L)$_n$, or (STA)-(L)-(TP-L)$_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10 (See for example exemplary insecticidal and/or nematicidal proteins as shown in FIG. 4, wherein n is an integer ranging from 1 to 200, preferably 1 to 100, and most preferably, 1 to 10). In related embodiments, the insecticidal and/or nematicidal protein may contain TPs that are the same or different, and binary and/or tertiary peptides that are the same or different. In related embodiments of the above, tertiary peptides (designated above as L), may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT. In another embodiment, a plant, or part thereof comprises a polynucleotide operably linked to an operable promoter, for example, a homologous or heterologous promoter, wherein the polynucleotide encodes an insecticidal and/or nematicidal protein comprising an ERSP fused in frame with the N-terminus of a stabilizing domain (STA). See FIGS. 5 and 6C.

The STA can be fused in frame with either the N-terminus of a binary or tertiary peptide, or the N-terminus of a construct comprising: (L-TP)$_n$, (L-TP)$_n$-L, (TP-L)$_n$, or L-(TP-L)$_n$.

In various embodiments, an exemplary insecticidal and/or nematicidal protein, and/or the DNA construct comprising one or more polynucleotides each or in combination encoding such insecticidal and/or nematicidal proteins can include the construct: (ERSP)-(STA)-(L-TP)$_n$, or (ERSP)-(STA)-(L-TP)$_n$-(L), or (ERSP)-(STA)-(TP-L)$_n$, or (ERSP)-(STA)-(L)-(TP-L)$_n$, or (STA)-(L-TP)$_n$, or (STA)-(L-TP)$_n$-(L), or (STA)-(TP-L)$_n$, or (STA)-(L)-(TP-L)$_n$, wherein TP is toxic protein, L is a binary or tertiary peptide and n is an integer ranging from 1 to 200, preferably an integer ranging from 1 to 100, and more preferably an integer ranging from 1 to 10. In some embodiments, the insecticidal and/or nematicidal protein may contain TPs that are the same or different, and binary and/or tertiary peptides may be the same or different. In some embodiments, the insecticidal and/or nematicidal protein has the C-terminal TP fused with or unfused at its C-terminus with a binary or tertiary peptide. In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

DNA constructs encoding a cleavable linking peptide operatively fused to a TP can be constructed with a variety of host cell specific regulatory components. In some embodiments, the DNA constructs may be transformed into a variety of host cells for expression, synthesis of encoded proteins or for genetic manipulation. In some embodiments, the host cell can be a bacterial cell, a yeast cell, a plant cell, or an animal cell, for example, an *Agrobacterium* cell, a *Bacillus* cell, an *Escherichia* cell, a *Salmonella* cell, a *Pseudomonas* cell, and a *Rhizobium* cell. In various embodiments, the host cell is a plant cell.

In some embodiments, the insecticidal and/or nematicidal compositions comprising cleavable linking peptides described herein are intended for the dissemination of TPs into insect and/or nematode pests that ingest or otherwise come into contact with the insecticidal and/or nematicidal compositions. The present invention provides a plant, or part thereof, (a "plant or part thereof", is defined herein as including, without limitation, a plant and the plant's tissue (for example, a plant's roots, stem, leaves, flowers or parts thereof), a plant cell, or a plant seed of said plant) comprising: an insecticidal and/or nematicidal protein or polypeptide comprising either a binary or a tertiary peptide, the binary and/or the tertiary peptide containing at least 4 amino acids and up to a maximum of 16 amino acids, and is comprised of 2 or 3 different regions, wherein the binary peptide has 2 different regions and the tertiary peptide has 3 different regions; wherein, the binary and/or the tertiary peptide can be cleaved by both an animal gut protease and an insect or nematode gut protease, and in some embodiments, the binary and/or the tertiary peptide is operably fused to the C-terminus of an Endoplasmic Reticulum Signal Peptide (ERSP) and operably fused to the N-terminus of a TP.

In some embodiments, the insecticidal and/or nematicidal compositions comprising cleavable linking peptides described herein are intended for the dissemination or consumption of TPs into or by insect and/or nematode pests that ingest or otherwise come into contact with the insecticidal and/or nematicidal compositions. The present invention provides a plant, or part thereof, (a "plant or part thereof", is defined herein as including, without limitation, a plant and the plant tissue, a plant cell, or a plant seed of said plant) comprising an insecticidal and/or nematicidal protein or polypeptide comprising one or more binary and/or tertiary peptides, the binary and/or the tertiary peptide containing at least 4 amino acids and up to a maximum of 16 amino acids, and is comprised of 2 or 3 different regions, wherein the binary peptide has 2 different regions and the tertiary peptide has 3 different regions; wherein, the binary and/or the tertiary peptide can be cleaved by both an animal gut protease, (for example a human gut protease) and an insect or nematode gut protease, and in some embodiments, the binary and/or the tertiary peptide is operably fused to the C-terminus of an Endoplasmic Reticulum Signal Peptide (ERSP) and operably fused to the N-terminus of a TP. In some of these embodiments, exemplary tertiary peptides (designated as L), may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In some embodiments, the insecticidal and/or nematicidal compositions comprising cleavable linking peptides described herein are intended for the dissemination or consumption of TPs into or by insect and/or nematode pests that ingest or otherwise come into contact with the insecticidal and/or nematicidal compositions. The present invention provides a plant, or part thereof, (a "plant or part thereof", is defined herein as including, without limitation, a plant and the plant tissue, a plant cell, or a plant seed of said plant) comprising an insecticidal and/or nematicidal protein or polypeptide comprising either a binary or a tertiary peptide, the binary and/or the tertiary peptide containing at least 4 amino acids and up to a maximum of 16 amino acids, and is comprised of 2 or 3 different regions, wherein the binary peptide has 2 different regions and the tertiary peptide has 3 different regions; wherein, the binary and/or the tertiary peptide can be cleaved by both an animal gut protease and an insect or nematode gut protease, and in some embodiments, the binary and/or the tertiary peptide is operably fused to the C-terminus of an Endoplasmic Reticulum Signal Peptide (ERSP) and operably fused to the N-terminus of a TP.

In a related embodiment, the plant or part thereof, comprises a polynucleotide that encodes an insecticidal and/or nematicidal protein, wherein the insecticidal and/or nematicidal protein comprises an ERSP fused in frame with the N-terminus of a binary or tertiary peptide, the binary or tertiary peptide is fused in frame with a construct comprising (TP-L)n or the insecticidal and/or nematicidal protein comprises an ERSP fused in frame with a binary peptide and/or a repeat construct (L-TP)n, or (TP-L)n. See FIG. 4. In various embodiments, the exemplary insecticidal and/or nematicidal protein can include a construct from N-terminus to C-terminus: (ERSP)-(L)-TP-(L)-TP, (ERSP)-(L)-TP-(L)-TP-(L), (L-TP)n-L, (L-TP-L)n, (ERSP)-(TP-L)n, (ERSP)-(L)-(TP-L)n, (ERSP)-(L-TP)n, (ERSP)-(L-TP)n-(L), (ERSP)-(STA)-(L-TP)n, (ERSP)-(STA)-(L-TP)n-(L), (ERSP)-(STA)-(TP-L)n, or (ERSP)-(STA)-(L)-(TP-L)n, or (STA)-(L-TP)n, or (STA)-(L-TP)n-(L), or (STA)-(TP-L)n, or (STA)-(L)-(TP-L)n, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some of these embodiments, exemplary tertiary peptides (designated as L), may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT. In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In another embodiment, a plant, or part thereof comprises a polynucleotide operably linked to an operable promoter, for example, a homologous or heterologous promoter, wherein the polynucleotide encodes an insecticidal and/or nematicidal protein comprising an ERSP fused in frame with the N-terminus of a stabilizing domain (STA). See FIG. 5. The STA is fused in frame with either the N-terminus of a binary or tertiary peptide, or the N-terminus of a construct comprising: $(L\text{-}TP)_n$, $(L\text{-}TP)_n\text{-}L$, $(TP\text{-}L)_n$, or $L\text{-}(TP\text{-}L)_n$. In various embodiments, the exemplary insecticidal and/or nematicidal protein can include: $(ERSP)\text{-}(STA)\text{-}(L\text{-}TP)_n$, or $(ERSP)\text{-}(STA)\text{-}(L\text{-}TP)_n\text{-}(L)$, or $(ERSP)\text{-}(STA)\text{-}(TP\text{-}L)_n$, or $(ERSP)\text{-}(STA)\text{-}(L)\text{-}(TP\text{-}L)_n$, or $(STA)\text{-}(L\text{-}TP)_n$, or $(STA)\text{-}(L\text{-}TP)_n\text{-}(L)$, or $(STA)\text{-}(TP\text{-}L)_n$, or $(STA)\text{-}(L)\text{-}(TP\text{-}L)_n$, wherein TP is toxic protein as described herein, L is a binary or tertiary peptide and n is an integer ranging from 1 to 200, preferably an integer ranging from 1 to 100, and more preferably an integer ranging from 1 to 10. In some embodiments, the insecticidal and/or nematicidal protein having a construct as shown above may contain TPs that are the same or different, and binary and/or tertiary peptides that are the same or different. In some of these embodiments, the insecticidal and/or nematicidal protein having a construct as shown above may contain a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In some embodiments, the C-terminal TP is fused or unfused at its C-terminus with a binary or tertiary peptide. See FIGS. 2, 4 and 5. In some of these embodiments, exemplary tertiary peptides (designated as L), may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

It should be appreciated by the reader that in practice a TP-Linker construct (the Linker being defined as including a cleavable binary or tertiary peptide) that can be written as $(TP-L)_n$, or the variations shown in FIG. 2 could also be written out in long form. For example, when n is 5 then $(TP-L)_n$ written out in long form would appear as: TP-L-TP-L-TP-L-TP-L-TP-L. After a construct like this is made and produced in a system such as a plant, or part thereof, the L or Linkers will be split apart by insect and/or nematode proteases in the gut or hemolymph environment of the insect and/or nematode to allow large numbers single toxic peptides to be released and exert their toxic effects, killing or immobilizing or slowing the feeding of the insects and/or nematodes. When this happens, depending on various circumstances, the L or Linker can be cleaved between different amino acids in the linker or between the Toxic Peptide and the linker such that on either side of the TP or Toxic Peptide there can be from 0 to 16 amino acids still attached to the toxic peptide remaining from the L or Linker that had an initial length of from 1-16 amino acids to start with. Said another way, post protease cleavage, the TP could either have no amino acids from the Linker attached to it, or it could have one or two “stubs” aka “nubbins” (one or both stubs fused to the N-terminus and/or the C-terminus) made of remnants of the Linker, that vary in size from one to 16 amino acids, but more often from 2, 3, 4, 5, 6, 7, 8, 9, 10, 11, 12, 13 or 14 amino acids. The stubs can be on the N-terminal, the C-terminal, or both the N-terminal and the C-terminals. These stubs are not always the same size, it depends on how they are cleaved by the proteases in the insect and/or human gut environment and this can vary depending on the protease and the Linker used. Normally there will be stubs attached to both “sides” of the Toxic Peptides with both stubs originating from different parts of the Linking Peptide. Sometimes there are no stubs or only 1 stub attached to the TP after cleavage.

The stubs can range in size from 1-16 amino acids, (and there may be no stubs) depending on the length of the starting Linker, more often the stubs will be from 2-14 amino acids, from 3-12, from 4-8, or from 5-7 amino acids or but they could be any of the following lengths of amino acids: from: 1-3, 1-4, 1-5, 1-6, 1-7, 1-8, 1-9, 10, 1-11, 2-3, 2-4, 2-5, 2-6, 2-7, 2-8, 2-9, 2-10, and 2-11, or 3-4, 3-5, 3-6, 3-7, 3-8, 3-9, 3-10, and 3-11, or 4-5, 4-6, 4-7, 4-8, 4-9, 4-10 and 4-11; or 5-6, 5-7, 5-8, 5-9, 5-10 and 5-11; or 6-7, 6-8, 6-9, 6-10 and 6-11; or 7-8, 7-9, 7-10, and 7-11; and 8-9, 8-10, or 8-11, and 9-10 or 9-11, or 10 or 11 amino acids in length.

Thus, when, before cleavage, the construct might appear as TP-L-TP-L-TP-L-TP-L-TP-L, (our example above, and shown in equation form in FIG. 2) where, for example, if the Linker has 6 aa (or amino acids), then after protease cleavage, the TP-L-TP-L-TP-L-TP-L-TP-L construct is broken up into individual Toxic Peptides (TPs) with stubs, which might appear as follows: the first peptide could be TP-2aa (2aa from one side of the 6 aa Linker) and then 4aa from the last part of the Linker attached to the other end of the toxic peptide as in: 4aa-TP-2aa, and a third peptide 4aa-TP-2aa, and a fourth 4aa-TP-2aa and then the fifth and last cleaved TP would appear as 4aa-TP-6aa, because the last Linker may not be cleaved. Sometimes cleavage does not always take place because the last TP of the construct is not attached to another TP. Or it might be cleaved leaving a 4aa-TP-2aa. These bits of aa fragments attached to the toxic peptides following peptidase cleavage are what we call “stubs” and they do not typically affect or inhibit the activity of the cleaved toxic peptides produced from cleavage in the insects’ gut.

Figure 5:
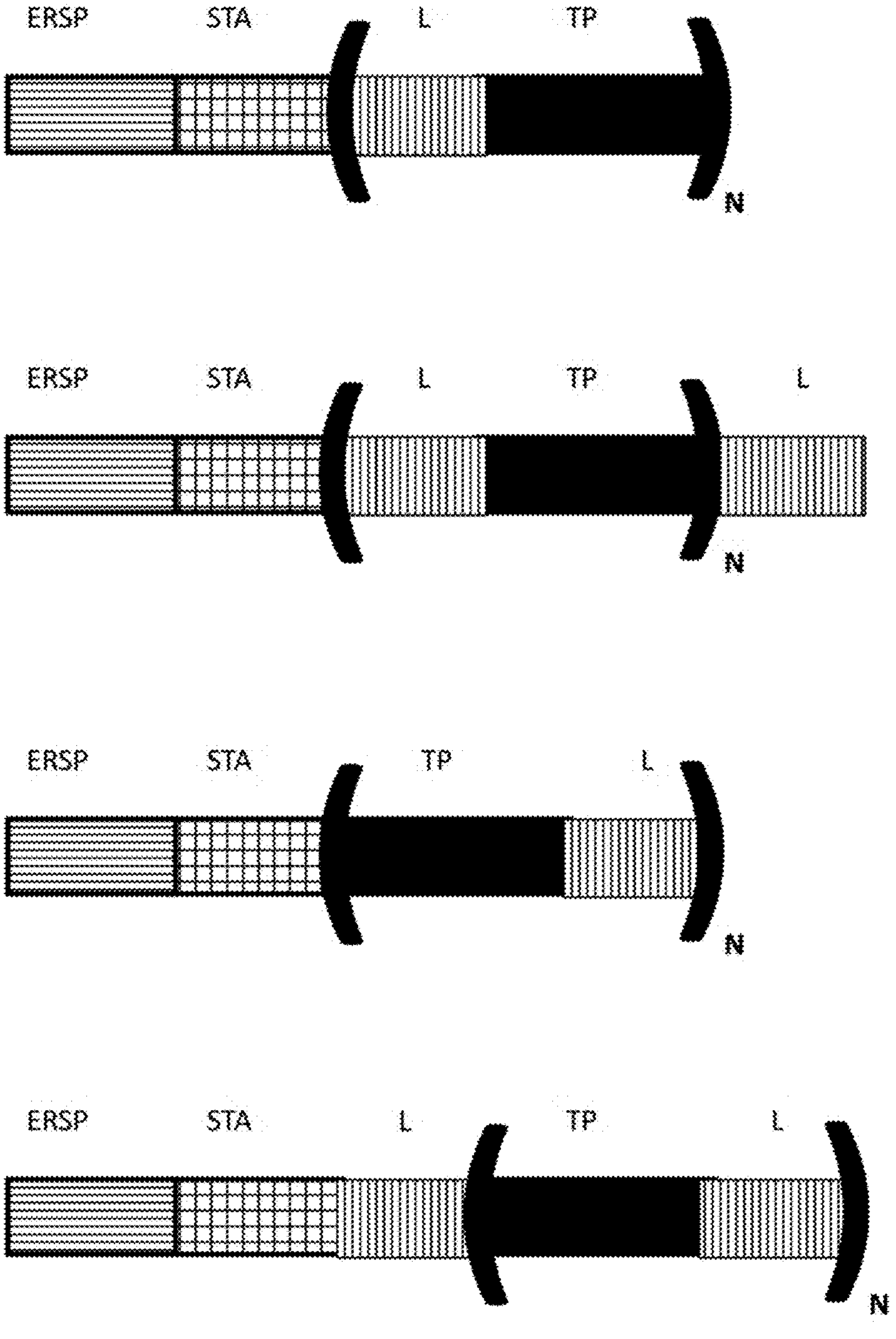
FIG. 5. Demonstration of the Binary or Tertiary Cleavable Linking Peptides of an exemplary insecticidal and/or nematicidal protein with two or more TPs and an ERSP fused to the N-terminal of the STA. This figure illustrates various embodiments from FIG. 2, with the addition of a STA and an N-terminal fusion of an ERSP to that STA.

Stubs may also appear when an ERSP is fused to the $(TP-L)_n$ or $(L-TP)_n$ as in FIG. 4 and in such a construct the stub could include pieces of the ERSP, and or in FIG. 5 where the L-TP is further fused to a STA or BAAS, or Ubiquitin, whatever is used in the construct. The stubs could be any combination of any length of peptide of 1 amino acid or greater up to 16 amino acids in length. They may be irregularly attached to the TP. Stubs may not have the same length or number of amino acids before and after the Toxic Peptide.

In various embodiments, a host cell is provided that has been transformed with a DNA construct described herein that is operable to express an insecticidal and/or nematicidal protein of the present invention. In various embodiments, the host cell may be a eukaryotic cell, for example, a yeast cell, for example, a yeast cell from the genus *Saccharomyces, Pichia, Hansenula, Kluyveromyces, Schizosaccharomyces, Schwanniomyces, Yarrowia, Aspergillus*; plant cells; and mammalian cells.

In various embodiments, the intended host cell that is transformed (transiently, or stably) with the DNA constructs encoding an insecticidal and/or nematicidal protein comprising a cleavable linking peptide operatively fused to a TP are plant cells. In some embodiments, the plant cells that may be transformed with the DNA constructs described herein may include but not limited to: alfalfa, banana, barley, bean, broccoli, cabbage, canola, carrot, cassava, castor, cauliflower, celery, chickpea, Chinese cabbage, citrus, coconut, coffee, corn, clover, cotton, a cucurbit, cucumber, Douglas fir, eggplant, *eucalyptus*, flax, garlic, grape, hops, leek, lettuce, Loblolly pine, millets, melons, nut, oat, olive, onion, ornamental, palm, pasture grass, pea, peanut, pepper, pigeon pea, pine, potato, poplar, pumpkin, *Radiata* pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and a wheat plant cell.

The present invention provides insecticidal and/or nematicidal proteins, such that when the insecticidal and/or nematicidal protein is ingested by an insect and/or a nematode, the gut environment proteases of the insect and/or nematode cleaves the binary and/or tertiary peptide thereby liberating the fused TPs and is killed, immobilized, rendered unable to function normally or slowing the feeding or growth of the insects and/or nematodes contacted with the insecticidal and/or nematicidal protein. In certain embodiments, the selection of TPs to be incorporated into the insecticidal and/or nematicidal protein can be made to target a specific insect or nematode pest, or for expression in a specific plant or specific conditions experienced by the plant. In some embodiments, an insecticidal and/or nematicidal protein which is produced by a transgenic plant, plant tissue, or plant seed or a composition comprising one or more insecticidal and/or nematicidal proteins having the same or different TPs formulated for direct application to a plant, has TPs comprised of a combination of ICK TPs and Bt TPs. The transgenic plant, plant tissue, or plant seed can express an insecticidal protein, or one or more plynucleotides encoding an insecticidal protein comprising one or more ICK TPs derived from any species of Australian Funnel-web spider, or the Australian Funnel-web spiders of genus *Atrax* or *Hadronyche*, and the Australian Blue Mountains Funnel-web, *Hadronyche versuta*. In some embodiments, the present invention provides a transgenic plant, or part thereof, (for example, a plant tissue, a plant cell, or a plant seed) wherein the transgenic plant or part thereof contains an insecticidal protein comprising a construct (from N-terminal to C-terminal) (ERSP)-(L)-TP-(L)-TP, (ERSP)-(L)-TP-(L)-TP-(L), (L-TP)$_n$-L, (L-TP-L)$_n$, (ERSP)-(TP-L)$_n$, (ERSP)-(L)-(TP-L)$_n$, (ERSP)-(L-TP)$_n$, (ERSP)-(L-TP)$_n$-(L), (ERSP)-(STA)-(L-TP)$_n$, (ERSP)-(STA)-(L-TP)$_n$-(L), (ERSP)-(STA)-(TP-L)$_n$, or (ERSP)-(STA)-(L)-(TP-L)$_n$, or (STA)-(L-TP)$_n$, or (STA)-(L-TP)$_n$-(L), or (STA)-(TP-L)$_n$, or (STA)-(L)-(TP-L)$_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10.

In related embodiments, the transgenic plant or part thereof may express an insecticidal and/or nematicidal protein that may contain TPs that are the same or different, and binary and/or tertiary peptides that are the same or different. In related embodiments, the transgenic plant, or part thereof, (for example, a plant tissue, a plant cell, or a plant seed) contains one or more polynucleotides each or in combination, operable to express an insecticidal protein comprising a construct, comprising, selected from the group consisting of, or consisting of: (from N-terminal to C-terminal) (ERSP)-(L)-TP-(L)-TP, (ERSP)-(L)-TP-(L)-TP-(L), (L-TP)$_n$-L, (L-TP-L)$_n$, (ERSP)-(TP-L)$_n$, (ERSP)-(L)-(TP-L)$_n$, (ERSP)-(L-TP)$_n$, (ERSP)-(L-TP)$_n$-(L), (ERSP)-(STA)-(L-TP)$_n$, (ERSP)-(STA)-(L-TP)$_n$-(L), (ERSP)-(STA)-(TP-L)$_n$, (ERSP)-(STA)-(L)-(TP-L)$_n$, (STA)-(L-TP)$_n$, (STA)-(L-TP)$_n$-(L), (STA)-(TP-L)$_n$, (STA)-(L)-(TP-L)$_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In related embodiments of the above, TPs useful in the manufacture of a transgenic plant or part thereof, comprising a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b or one or more TPs having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In related embodiments, the one or more polynucleotides are provided in an expression vector, operable to express an insecticidal and/or nematicidal protein as described above and herein, and is under the control of a constitutive or inducible promoter, wherein the expression vector is transiently expressed in a host cell, for example, a plant cell, or wherein the polynucleotide operable to encode the insecticidal protein is stably integrated into the plant's, or part thereof nuclear DNA. In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1 b (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In some embodiments, methods for controlling an insect and/or nematode pest may include applying a formulation comprising an insecticidal and/or nematicidal protein comprising a combination of a Bt (*Bacillus thuringiensis*) TP and an ICK (Inhibitor Cystine Knot) TP to said insect and/or nematode. Upon release of at least 50% of the TPs from the insecticidal and/or nematicidal protein, the ratio of Bt TP to ICK TP, on a dry weight basis thus released, can be selected from at least about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. The ratio of Bt TP to ICK TP, on a dry weight basis thus released, can be selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. The formulation may comprise the insecticidal and/or nematicidal protein and appropriate excipients, or the insecticidal and/or nematicidal protein may be expressed by a culture of one or more bacterial strains, that when formulated and applied to the plant, the bacterial strains produce the insecticidal and/or nematicidal protein which is subsequently ingested by the insect and/or nematode pest. In various embodiments, the total concentration of Bt TP and ICK TP in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients. Any of the insecticidal and/or nematicidal proteins and plants described herein can be used to control insects and/or nematodes, their growth and damage, especially their damage to plants. In some embodiments, insecticidal and/or nematicidal proteins comprising the combination of Bt TP and ICK TP can be applied by being sprayed on a plant, or the insect's locus, or the locus of a plant in need of protecting.

In some embodiments, illustrative methods for controlling a pest infection comprises preparing a formulation comprising: an insecticidal and/or nematicidal protein comprising a combination of a Bt TP; and an ICK TP, which can include any of the compositions described herein or capable of being made by one skilled in the art given this disclosure. Some of the described formulations include the use of a polar aprotic solvent, and or water, and or where the polar aprotic solvent is present in an amount of 1-99 wt %, the polar protic solvent is present in an amount of 1-99 wt %, and the water is present in an amount of 0-98 wt %. The formulations include formulations where the Bt TP is Dipel and where the ICK TP is a hybrid-ACTX-Hv1a peptide, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different).

The polar aprotic solvent formulations are especially effective when they contain MSO. The examples below are intended to illustrate and not limit the invention in any manner.

In some embodiments, an insecticidal and/or nematicidal proteins which are produced by a transgenic plant, or part thereof or formulated for direct application to a plant, comprises a combination of a Bt TP and a TMOF TP, that when combined in a single insecticidal and/or nematicidal protein, may inhibit the growth, impair the movement, or even kill an insect when the combination of TPs is appropriately delivered to the locus inhabited by the insect. The spray-dried powders are can be made using as the primary active agent an insecticidal and/or nematicidal protein as described herein comprising a combination of TPs as discussed above, and one or more various excipients and fermentation by-products.

We describe an insecticidal and/or nematicidal protein composition comprising both a Bt (*Bacillus thuringiensis*) protein; and a TMOF TP. In some embodiments, methods for controlling an insect and/or nematode pest may include applying a formulation comprising an insecticidal and/or nematicidal protein comprising a combination of a Bt (*Bacillus thuringiensis*) TP and a TMOF TP to said insect and/or nematode. Upon release of at least 50% of the TPs from the insecticidal and/or nematicidal protein, the ratio of Bt TP to TMOF TP, on a dry weight basis thus released, can be selected from about any or all of the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. The formulation may comprise the insecticidal and/or nematicidal protein and appropriate excipients, or the insecticidal and/or nematicidal protein may be expressed by a culture of one or more bacterial strains, that when formulated and applied to the plant, the bacterial strains produce the insecticidal and/or nematicidal protein which is subsequently ingested by the insect and/or nematode pest. In various embodiments, the total concentration of Bt TP and TMOF TP in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients. Any of the insecticidal and/or nematicidal proteins and plants described herein can be used to control insects and/or nematodes, their growth and damage, especially their damage to plants. In some embodiments, insecticidal and/or nematicidal proteins comprising the combination of Bt TP and TMOF TP can be applied by being sprayed on a plant, or the insect's locus, or the locus of a plant in need of protecting.

In some embodiments, illustrative methods for controlling a pest infection comprises preparing a formulation comprising: an insecticidal and/or nematicidal protein comprising a combination of a Bt TP; and a TMOF TP, which can include any of the compositions described herein or capable of being made by one skilled in the art given this disclosure. Some of the described formulations include the use of a polar aprotic solvent, and or water, and or where the polar aprotic solvent is present in an amount of 1-99 wt %, the polar protic solvent is present in an amount of 1-99 wt %, and the water is present in an amount of 0-98 wt %. In certain embodiments, as provided herein, the insecticidal and/or nematicidal protein for any combination of TPs can include one or more binary and/or tertiary peptides. The insecticidal and/or nematicidal protein can include one or more TPs from the illustrative combination linked to a tertiary peptide, in which the spacer is positioned either to the N-terminal side of the binary peptide portion of the tertiary peptide or to the C-terminal side of the binary peptide portion of the tertiary peptide. In some embodiments, the spacer is a dipeptide, for example, GS, which may be operably linked to the TMOF TP units within the insecticidal and/or nematicidal protein. In some embodiments, the spacer dipeptide is linked at the N-terminal of the TMOF TP; and wherein the spacer is comprised of one nonpolar amino acid on the N-terminal of the dipeptide and one polar amino acid on the C-terminal of the dipeptide, including embodiments where the dipeptide is glycine-serine, including embodiments where the TMOF TP includes embodiments where the TMOF TP is at least 50%, 55%, 60%, 65%, 70%, 75%, 80%, 85%, 90%, 95%, 96%, 97%, 98%, or 99% or greater sequence identity to any of the TMOF sequences disclosed herein, including embodiments where the Bt Protein is any Bt TP, including embodiments where the Bt TP is a Cry or Cyt protein, including embodiments where the Bt TP is selected from the group consisting of a Cry1, Cry3, TIC851, CryET70, Cry22, TIC901, TIC201, TIC407, TIC417, a binary insecticidal protein CryET80, and CryET76, a binary insecticidal protein TIC100 and TIC101, a combination of an insecticidal protein ET29 or ET37 with an insecticidal protein TIC810 or TIC812 and a binary insecticidal protein PS149B1, including embodiments where the Bt TP is selected from a Cry protein, a Cry1A protein or a Cry1F protein, including embodiments where the Bt TP is a combination Cry1F-Cry 1A protein, including embodiments where the Bt TP comprises an amino acid sequence at least 90% identical to SEQ ID NO: 10, 12, 14, 26, 28, or 34 of U.S. Pat. No. 7,304,206, including embodiments where the Bt Endotoxin is Dipel, including embodiments where the Bt Protein is Thuricide.

In some embodiments, methods for controlling an insect and/or nematode pest may include applying a formulation comprising an insecticidal and/or nematicidal protein comprising a combination of a Bt (*Bacillus thuringiensis*) TP and a TMOF TP to said insect and/or nematode. Upon release of at least 50% of the TPs from the insecticidal and/or nematicidal protein, the ratio of Bt TP to TMOF TP, on a dry weight basis thus released, can be selected from at least about the following ratios: 99:1, 95:5, 90:10, 85:15, 80:20, 75:25, 70:30, 65:35, 60:40, 55:45, 50:50, 45:55, 40:60, 35:65, 30:70, 25:75, 20:80, 15:85, 10:90, 5:95 and 1:99, or any combination of any two of these values. The ratio of Bt TP to TMOF TP, on a dry weight basis thus released, can be selected from about the following ratios: 50:50, 45:55, 40:60, 35:65, 30:70, 25:75, 20:80, 15:85, 10:90, 5:95, 1:99, 0.5:99.5, 0.1:99.9 and 0.01:99.99 or any combination of any two of these values. The formulation may comprise the insecticidal and/or nematicidal protein and appropriate excipients, or the insecticidal and/or nematicidal protein may be expressed by a culture of one or more bacterial strains, that when formulated and applied to the plant, the bacterial strains produce the insecticidal and/or nematicidal protein which is subsequently ingested by the insect and/or nematode pest. In various embodiments, the total concentration of Bt TP and TMOF TP in the composition is selected from the following percent concentrations: 1, 5, 10, 15, 20, 25, 30, 35, 40, 45, 50, 55, 60, 65, 70, 75, 80, 85, 90, 95 or 99%, or any range between any two of these values, and the remaining percentage of the composition is comprised of excipients. Any of the insecticidal and/or nematicidal proteins and plants described herein can be used to control insects and/or nematodes, their growth and damage, especially their damage to plants. In some embodiments, insecticidal and/or nematicidal proteins comprising the combination of Bt TP and TMOF TP can be applied by being sprayed on a plant, or the insect's locus, or the locus of a plant in need of protecting.

In some embodiments, the method for controlling a pest infection includes providing a transformed plant expressing an insecticidal and/or nematicidal protein expressing the combination of Bt TP and TMOF TPs described herein where the average concentration of each of Bt and TMOF TPs as a percentage weight of the total amount of expressed TP in an average leaf of a transformed plant is about: 1, 5, 10, 15, 20, 25, 30, 35, 40, 45, 50, 55, 60, 65, 70, 75, 80, 85, 90, 95 or 99%, or any range between any two of these values.

In some embodiments, the insecticidal and/or nematicidal protein expressing the combination of Bt TP and TMOF TPs described herein is expressed in corn, soybean, cotton, rice, sorghum, switchgrass, sugarcane, alfalfa, potatoes or tomatoes. In some embodiments, the insecticidal and/or nematicidal protein is expressed in a transgenic seed having an insecticidal and/or nematicidal protein as described above.

In some embodiments, a transformed plant expressing properly folded combination of Bt TP and TMOF TPs described herein in the transformed plant and to cause the accumulation of the expressed and properly folded combination of Bt TP and TMOF TPs described herein in said plant and to cause an increase in the plant's yield or resistance to insect and/or nematode damage and they control insect and/or nematode pests in crops and natural or man-made forests. We describe transgenic plants made by any of the products and processes described herein.

(5). Transgenic Plants

Methods of the invention involve introducing a nucleotide or DNA construct into a host cell, for example, a plant. By "introducing" is intended to present to the plant the DNA construct in such a manner that the construct gains access to the interior of a cell of the plant. The methods of the invention do not require that a particular method for introducing a DNA construct to a plant is used, only that the DNA construct gains access to the interior of at least one cell of the plant. Methods for introducing DNA constructs into plants are known in the art including, but not limited to, stable transformation methods, transient transformation methods, and virus-mediated methods. Methods for transforming polynucleotides including cloning and expression vectors containing insecticidal proteins are known in the art. For example, methods for cloning and transforming plants by introducing recombinant insecticidal proteins fused to signal peptides and molecular markers can be found in International PCT Application Serial No. PCT/US2013/030042 filed on Mar. 8, 2013, the contents of the disclosure are incorporated by reference herein in its entirety. In some embodiments, By "plant" is intended whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic plants" or "transformed plants" or "stably transformed" plants or cells or tissues refers to plants that have incorporated or integrated exogenous nucleic acid sequences or DNA fragments into the plant cell. These nucleic acid sequences include those that are exogenous, or not present in the untransformed plant cell, as well as those that may be endogenous, or present in the untransformed plant cell. "Heterologous" generally refers to the nucleic acid sequences that are not endogenous to the cell or part of the native genome in which they are present, and have been added to the cell by infection, transfection, microinjection, electroporation, microprojection, or the like.

Transformation of plant cells can be accomplished by one of several techniques known in the art. The DNA construct of the invention may be modified to obtain or enhance expression in plant cells. Typically a construct that expresses such a protein would contain a promoter to drive transcription of the gene, as well as a 3' untranslated region to allow transcription termination and polyadenylation. The organization of such constructs is well known in the art. In some instances, it may be useful to engineer the gene such that the resulting peptide is secreted, or otherwise targeted within the plant cell. For example, the gene can be engineered to contain a signal peptide to facilitate transfer of the peptide to the endoplasmic reticulum. It may also be preferable to engineer the plant expression cassette to contain an intron, such that mRNA processing of the intron is required for expression.

In various embodiments, DNA constructs comprising a polynucleotide that encodes an insecticidal and/or nematicidal protein of the present invention may be transiently or stably transformed into unmodified plant cells or may be transformed into previously genetically altered plant cells. In one embodiment, DNA constructs comprising a polynucleotide that encodes an insecticidal and/or nematicidal protein of the present invention may be stably transformed into unmodified plant cells, i.e. plant cells that have not previously been transformed or transfected with any heterologous DNA or RNA material. Methods for stable integration of foreign or heterologous expression vectors, are described below. In other embodiments, the genetically unaltered plant cells can be transformed with one DNA construct comprising a polynucleotide operable to encode one insecticidal and/or nematicidal protein of the present invention. In this embodiment, the insecticidal and/or nematicidal protein contains only one type of TP, for example, an ICK motif TP. In other embodiments, the genetically unaltered plant cells can be transformed with two different DNA constructs, each construct comprising a polynucleotide operable to encode one insecticidal and/or nematicidal protein of the present invention, wherein the insecticidal and/or nematicidal protein of each construct comprises different TPs, for example, in one DNA construct, the insecticidal and/or nematicidal protein comprises one or more copies of an ICK motif TP and the other DNA construct comprises a polynucleotide that encodes a different TP, for example a Bt TP. Expression of both types of insecticidal and/or nematicidal proteins can be manipulated by using the same promoter or different promoters and other control sequences to cause the differential expression of either insecticidal and/or nematicidal protein, or both insecticidal and/or nematicidal proteins together.

In some embodiments, a transgenic plant or part thereof, can produce or express one or more insecticidal and/or nematicidal proteins containing one or more TPs. In one embodiment, the TP is an ICK TP, for example, a Hybrid-ACTX-Hv1a, for example, a TP having an amino acid sequence of SEQ ID NO: 5 or 6 (or a variant thereof) and/or the ICK TP expressed may contain 20-100 amino acids and 2-4 disulfide bonds and or the ICK TP is any insecticidal peptide with at least 50%, 55%, 60%, 65%, 70%, 75%, 80%, 85%, 90%, 95%, 96%, 97%, 98%, or 99% or greater sequence identity to any of the ICK TPs described herein and/or a Bt TP and specifically exemplified in any TP having an amino acid sequence as set forth in SEQ ID NOs: 5-1593 and 1761-1775, or a variant thereof.

In various embodiments, a transgenic plant may express and produce one or more ICK TPs, which may be the same or they may be different, (for example, an Omega-ACTX TP, a Kappa-ACTX TP or a U-ACTX TP, for example, a Hybrid-ACTX-Hv1a TP), or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different).

In another embodiment, a transgenic plant or part thereof, may express and produce one or more Bt TPs, which may be the same or different. It is to be understood, that although a transgenic plant, or part thereof may express and produce the same type of TPs or different TPs, a transgenic plant will not have a single DNA construct which is operable to encode and express an ICK TP and a Bt TP from the same DNA construct. These two types of TPs may be expressed and produced in a plant or part thereof, but these two types of TPs originate from separate DNA constructs as described herein. The transgenic plants disclosed herein can contain, express, and produce an insecticidal and/or nematicidal protein containing a known Bt TP, including a Cry or Cyt protein TP, and/or a Bt TP selected from the group consisting of a Cry1, Cry3, TIC851, CryET70, Cry22, TIC901, TIC201, TIC407, TIC417, a CryET80, and CryET76, TIC100 TIC101, ET29, ET37, TIC810, TIC812, PS149B1, and combinations thereof. The Bt TP can be selected from a Cry protein, a Cry1A protein or a Cry1F protein, or a combination Cry1F-Cry1A protein, or it comprises an amino acid sequence at least 90% identical to SEQ ID NO: 10, 12, 14, 26, 28, or 34 of U.S. Pat. No. 7,304,206. In some embodiments, a transgenic plant can produce an insecticidal and/or nematicidal protein comprising a Bt TP, for example, Dipel and/or Thuricide.

In some embodiments, a transgenic plant expressing the TPs described herein where the average concentration of each of Bt and ICK TPs as a percentage weight of the total amount of expressed TP in an average leaf of a transformed plant is about: 1, 5, 10, 15, 20, 25, 30, 35, 40, 45, 50, 55, 60, 65, 70, 75, 80, 85, 90, 95 or 99%, or any range between any two of these values.

In some embodiments, the insecticidal and/or nematicidal protein described herein is expressed in corn, soybean, cotton, rice, sorghum, switchgrass, sugarcane, alfalfa, potatoes or tomatoes. In some embodiments, the insecticidal and/or nematicidal protein is expressed in a transgenic seed having an insecticidal and/or nematicidal protein as described above.

In other embodiments, a DNA construct comprising a polynucleotide operable to encode an insecticidal and/or nematicidal protein of the present invention can be transiently or stably expressed in a plant cell that has been previously genetically modified, for example, a plant cell that has been previously transformed with another TP, for example, an ICK motif TP or a Bt TP as described herein. In this embodiment, the DNA construct of the present invention can be transformed such that the expression of either the insecticidal and/or nematicidal protein or the previously introduced TP can be controlled by the same promoters or each of the insecticidal and/or nematicidal protein and previously introduced TP can be controlled using different promoters or expression conditions to facilitate differential expression of both. It is to be understood, that transformation of two different Bt TPs cannot occur, whether the DNA construct comprises a polynucleotide operable to encode an insecticidal and/or nematicidal protein having multiple TPs or transformation of multiple DNA constructs containing single TPs. In either case, only a single species of Bt TP can be transformed into the plant, whether expressed as a single TP or in insecticidal and/or nematicidal proteins containing multiple copies of the same species of Bt TP.

In some embodiments, the present invention provides a transgenic plant comprising a combination of a Bt (*Bacillus thuringiensis*) TP and an ICK (Inhibitor Cystine Knot) TP. This transgenic plant can be made from independent and separate stable genetic insertions of DNA constructs as provided herein that create a first flowering plant expressing a Bt TP and a second flowering plant expressing an ICK TP. The pollen of one of those plants will be crossed onto the female flower organs of the other plant to form a genetic hybridization that contains both an insecticidal and/or nematicidal proteins comprising a Bt TP and a different insecticidal and/or nematicidal protein that comprises an ICK TP genetic traits. The progeny of that sexual cross and further crossing that results in the inheritance of both traits will result in a transgenic plant comprising a combination of a Bt (*Bacillus thuringiensis*) TP and an ICK (Inhibitor Cystine Knot) TP.

In some embodiments, transgenic plants or parts thereof, are operable to express an insecticidal and/or nematicidal protein encoded by a DNA construct encoding an insecticidal and/or nematicidal protein, wherein the insecticidal and/or nematicidal protein comprises an ERSP fused in frame with the N-terminus of a binary or tertiary peptide, the binary or tertiary peptide is fused in frame with a construct comprising $(TP-L)_n$ or the insecticidal and/or nematicidal protein comprises an ERSP fused in frame with a binary peptide and/or a repeat construct $(L-TP)_n$ or $(TP-L)_n$. In various embodiments, the exemplary insecticidal and/or nematicidal protein can include the construct: (ERSP)-$(TP-L)_n$, or (ERSP)-(L)-$(TP-L)_n$, or (ERSP)-$(L-TP)_n$, or (ERSP)-$(L-TP)_n$-(L). In another embodiment, a transgenic plant, or part thereof comprises a polynucleotide operably linked to an operable promoter, wherein the polynucleotide encodes an insecticidal and/or nematicidal protein comprising an ERSP fused in frame with the N-terminus of a stabilizing domain (STA). The STA is fused in frame with either the N-terminus of a binary or tertiary peptide, or the N-terminus of a construct comprising: $(L\text{-}TP)_n$, $(L\text{-}TP)_n$-L, $(TP\text{-}L)_n$, or L-$(TP\text{-}L)_n$. In various embodiments, an exemplary insecticidal and/or nematicidal protein can include a construct from N-terminus to C-terminus: (ERSP)-(L)-TP-(L)-TP, (ERSP)-(L)-TP-(L)-TP-(L), $(L\text{-}TP)_n$-L, $(L\text{-}TP\text{-}L)_n$, (ERSP)-$(TP\text{-}L)_n$, (ERSP)-(L)-$(TP\text{-}L)_n$, (ERSP)-$(L\text{-}TP)_n$, (ERSP)-$(L\text{-}TP)_n$-(L), (ERSP)-(STA)-$(L\text{-}TP)_n$, (ERSP)-(STA)-$(L\text{-}TP)_n$-(L), (ERSP)-(STA)-$(TP\text{-}L)_n$, or (ERSP)-(STA)-(L)-$(TP\text{-}L)_n$, or (STA)-$(L\text{-}TP)_n$, or (STA)-$(L\text{-}TP)_n$-(L), or (STA)-$(TP\text{-}L)_n$, or (STA)-(L)-$(TP\text{-}L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide. In related embodiments of the above, transgenic plants or parts thereof may comprise one or more TPs useful in the manufacture of an insecticidal and/or nematicidal protein. Transgenic plants or parts thereof may comprise an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b, or a hybrid-ACTX-Hv1a peptide, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In various embodiments, the plant or part thereof, for example a plant cell, has been previously transformed with a Bt TP and the plant or part thereof, for example a plant cell containing a Bt TP is subsequently transformed with a DNA construct operable to encode an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b, or a hybrid-ACTX-Hv1a peptide, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT. The resulting plant or part thereof, for example, a plant cell, has stable expression of a Bt TP and an insecticidal and/or nematicidal protein containing one or more ICK motif TPs.

In various embodiments, insecticidal and/or nematicidal proteins can also be integrated into plant genome using stable plant transformation technology, and therefore insecticidal and/or nematicidal proteins can be stably expressed in plants and protect the transformed plants from generation to generation. For the stable transformation of plants, an expression vector comprising the DNA construct can be circular or linear. A few critical components must be included in the vector DNA. The insecticidal and/or nematicidal insecticidal and/or nematicidal protein ORF for stable plant transformation should be carefully designed for optimal expression in plants based on the study in the transient plant expression as described above. The expression of insecticidal and/or nematicidal insecticidal and/or nematicidal protein is usually controlled by a promoter that drives transcription in some of all cells of the transgenic plant. The promoter can be a strong plant viral promoter, for example, the constitutive 35S promoter from Cauliflower Mosaic Virus (CaMV); it also can be a strong plant promoter, for example, the hydroperoxide lyase promoter (pHPL) from *Arabidopsis thaliana*; the *Glycine max* polyubiquitin (Gmubi) promoter from soybean; the ubiquitin promoters from different plant species (rice, corn, potato, etc.), etc. A plant transcriptional terminator often occurs after the stop codon of the ORF to halt the RNA polymerase and transcription of the mRNA. To evaluate the insecticidal and/or nematicidal insecticidal and/or nematicidal protein expression, a reporter gene can be included in the expression vector, for example, beta-glucuronidase gene (GUS) for GUS straining assay, green fluorescent protein (GFP) gene for green fluorescence detection under UV light, etc. For selection of transformed plants, a selection marker gene is usually included in the expression vector. The marker gene expression product can provide the transformed plant with resistance to specific antibiotics, for example, kanamycin, hygromycin, etc., or specific herbicide, for example, glyphosate etc. If agroinfection technology is adopted for plant transformation, T-DNA left border and right border sequences are also included in the expression vector to transport the T-DNA portion into the plant. The constructed expression vector can be transformed into plant cells or tissues using any number of established and well known transformation technologies. Agroinfection is a very popular way to transform a plant using an *Agrobacterium tumefaciens* strain or an *Agrobacterium rhizogenes* strain. Particle bombardment (also called Gene Gun, or Biolistics) technology is also very commonly used for plant transformation. Other less commonly used transformation methods include tissue electroportation, silicon carbide whiskers, direct injection of DNA, etc. After transformation, the transformed plant cells or tissues placed on plant regeneration media to regenerate successfully transformed plant cells or tissues into transgenic plants. The evaluation of the integration and expression of the insecticidal and/or nematicidal insecticidal and/or nematicidal protein ORF in the transformed plant can be performed.

In some embodiments, a "plant expression cassette" can be inserted into a "plant transformation vector". The illustrative plant transformation vector may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the insecticidal and/or nematicidal protein described herein are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux (2000) Trends in Plant Science 5:446-451). Several types of *Agrobacterium* strains (e.g., LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g. Hiei et al. (1994) The Plant Journal 6:271-282; Ishida et al. (1996) Nature Biotechnology 14:745-750). Explants are typically transferred to a fresh supply of the same medium and cultured routinely. A general description of the techniques and methods for generating transgenic plants are found in Ayres and Park (1994) Critical Reviews in Plant Science 13:219-239 and Bommineni and Jauhar (1997) Maydica 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

Transformation protocols as well as protocols for introducing nucleotide sequences into plants may vary depending on the type of plant or plant cell, i.e., monocot or dicot, targeted for transformation. Generation of transgenic plants may be performed by one of several methods, including, but not limited to, microinjection, electroporation, direct gene transfer, introduction of heterologous DNA by *Agrobacterium* into plant cells (*Agrobacterium*-mediated transformation), bombardment of plant cells with heterologous foreign DNA adhered to particles, ballistic particle acceleration, aerosol beam transformation (U.S. Published Application No. 20010026941; U.S. Pat. No. 4,945,050; International Publication No. WO 91/00915; U.S. Published Application No. 2002015066), Led 1 transformation, and various other non-particle direct-mediated methods to transfer DNA.

Methods for transformation of chloroplasts are known in the art. See, for example, Svab et al. (1990) Proc. Natl. Acad. Sci. USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) Proc. Natl. Acad. Sci. USA 91:7301-7305.

Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

The cells that have been transformed may be grown into plants in accordance with conventional ways. See, for example, McCormick et al. (1986) Plant Cell Reports 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

(5A). Evaluation of Plant Transformations

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, 2001, supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled.sup.32P target DNA fragment to confirm the integration of introduced gene into the plant genome according to standard techniques (Sambrook and Russell, 2001, supra).

In Northern blot analysis, RNA is isolated from specific tissues of transformant, fractionated in a formaldehyde agarose gel, and blotted onto a nylon filter according to standard procedures that are routinely used in the art (Sambrook and Russell, 2001, supra). Expression of RNA encoded by the Bt-protein is then tested by hybridizing the filter to a radioactive probe derived from a Bt-protein, by methods known in the art (Sambrook and Russell, 2001, supra).

Western blot, biochemical assays and the like may be carried out on the transgenic plants to confirm the presence of the transformed TP by standard procedures (Sambrook and Russell, 2001, supra) using antibodies that bind to one or more epitopes present on the TP.

Accordingly, the present invention provides a transgenic plant or part thereof, which comprises a polynucleotide operably linked to an operable promoter, for example, a homologous or heterologous promoter, wherein the polynucleotide encodes: a peptide comprising either a binary or a tertiary peptide as described herein. In some embodiments, the binary or tertiary peptide can include an amino acid sequence of at least 4 amino acids and up to a maximum of 16 amino acids. The binary peptide has two regions and the tertiary has the same two regions and one additional region called a spacer. Each of the binary and/or tertiary peptides can be cleaved by both an animal gut protease, for example a human gastrointestinal protease and an insect or nematode gut protease. In various embodiments, the polynucleotide also encodes an Endoplasmic Reticulum Signal Peptide (ERSP) which is fused at its C-terminus with the N-terminus of a binary and/or tertiary peptide. In these embodiments, the binary and/or tertiary peptides are also operably fused to the N-terminus of a TP. In still other embodiments, the transgenic plant may contain a cell or a plurality of cells transformed with a DNA construct comprising at least one polynucleotide operably linked to an operable promoter, for example, a homologous or heterologous promoter, wherein the polynucleotide encodes an insecticidal and/or nematicidal protein having two or more cleavable binary or tertiary peptides. The insecticidal and/or nematicidal protein comprises an ERSP fused in frame at its C-terminus with the N-terminus of the binary or tertiary peptide, and the binary or tertiary peptide is fused in frame at its C-terminus with a construct comprising: $(TP-L)_n$ wherein TP is toxic peptide or protein, L is a binary or tertiary peptide and n is an integer ranging from 1 to 200, or from 1 to 100, or from 1 to 10. In these insecticidal and/or nematicidal proteins, the last TP of the insecticidal and/or nematicidal protein, i.e. at its C-terminus, may be fused or unfused at its C-terminus with a binary or tertiary peptide. In various embodiments, an exemplary insecticidal and/or nematicidal protein can include the structure: (ERSP)-$(TP-L)_n$, or (ERSP)-(L)-$(TP-L)_n$, or (ERSP)-$(L-TP)_n$, or (ERSP)-$(L-TP)_n$-(L). In another embodiment, a plant, or part thereof comprises a polynucleotide operably linked to an operable promoter, for example, a homologous or heterologous promoter, wherein the polynucleotide encodes an insecticidal and/or nematicidal protein comprising an ERSP fused in frame with the N-terminus of a stabilizing domain (STA). The STA is fused in frame with either the N-terminus of a binary or tertiary peptide, or the N-terminus of a construct comprising: $(L-TP)_n$, $(L-TP)_n$-L, $(TP-L)_n$, or L-$(TP-L)_n$. In various embodiments, an exemplary insecticidal and/or nematicidal protein can comprise, or selected from the group consisting of, or consisting of a construct from N-terminus to C-terminus: (ERSP)-(L)-TP-(L)-TP, (ERSP)-(L)-TP-(L)-TP-(L), $(L-TP)_n$-L, $(L-TP-L)_n$, (ERSP)-$(TP-L)_n$, (ERSP)-(L)-$(TP-L)_n$, (ERSP)-$(L-TP)_n$, (ERSP)-$(L-TP)_n$-(L), (ERSP)-(STA)-$(L-TP)_n$, (ERSP)-(STA)-$(L-TP)_n$-(L), (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide.

In some embodiments, transgenic plants or parts thereof, that may be receptive to the expression of insecticidal and/or nematicidal peptide compositions comprising a cleavable linking peptide described herein, can include: alfalfa, banana, barley, bean, broccoli, cabbage, canola, carrot, cassava, castor, cauliflower, celery, chickpea, Chinese cabbage, citrus, coconut, coffee, corn, clover, cotton, a cucurbit, cucumber, Douglas fir, eggplant, *eucalyptus*, flax, garlic, grape, hops, leek, lettuce, Loblolly pine, millets, melons, nut, oat, olive, onion, ornamental, palm, pasture grass, pea, peanut, pepper, pigeonpea, pine, potato, poplar, pumpkin, *Radiata* pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and a wheat plant. In some embodiments the transgenic plant may be grown from cells that were initially transformed with the DNA constructs described herein. In other embodiments, the transgenic plant may express the encoded insecticidal and/or nematicidal peptide compositions in a specific tissue, or plant part, for example, a leaf, a stem a flower, a sepal, a fruit, a root, or a seed or combinations thereof.

In another aspect of the invention, one may generate transgenic plants expressing an insecticidal and/or nematicidal insecticidal and/or nematicidal protein that when cleaved in the presence of an appropriate protease has pesticidal activity. Methods described above by way of example may be utilized to generate transgenic plants, but the manner in which the transgenic plant cells are generated is not critical to this invention. Methods known or described in the art such as *Agrobacterium*-mediated transformation, biolistic transformation (See for example, Kikkert J R1, Vidal J R, Reisch B I., "Stable transformation of plant cells by particle bombardment/biolistics.", Methods Mol Biol. 2005; 286:61-78, the disclosure of which is incorporated herein by reference in its entirety), and non-particle-mediated methods may be used. Plants expressing an insecticidal and/or nematicidal insecticidal and/or nematicidal protein may be isolated by common methods described in the art, for example by transformation of callus, selection of transformed callus, and regeneration of fertile plants from such transgenic callus. In such process, one may use any gene as a selectable marker so long as its expression in plant cells confers ability to identify or select for transformed cells.

A number of markers have been developed for use with plant cells, such as resistance to chloramphenicol, the aminoglycoside G418, hygromycin, or the like. Other genes that encode a product involved in chloroplast metabolism may also be used as selectable markers. For example, genes that provide resistance to plant herbicides such as glyphosate, bromoxynil, or imidazolinone may find particular use. Such genes have been reported (Stalker et al. (1985) J. Biol. Chem. 263:6310-6314 (bromoxynil resistance nitrilase gene); and Sathasivan et al. (1990) Nucl. Acids Res. 18:2188 (AHAS imidazolinone resistance gene). Additionally, the genes disclosed herein are useful as markers to assess transformation of bacterial or plant cells. Methods for detecting the presence of a transgene in a plant, plant organ (e.g., leaves, stems, roots, etc.), seed, plant cell, propagule, embryo or progeny of the same are well known in the art. In one embodiment, the presence of the transgene is detected by testing for pesticidal activity.

Fertile plants expressing an insecticidal and/or nematicidal protein may be tested for pesticidal activity, and the plants showing optimal activity selected for further breeding. Methods are available in the art to assay for pest activity. Generally, the cleaved TP is mixed and used in feeding assays. See, for example Marrone et al. (1985) J. of Economic Entomology 78:290-293.

Accordingly, the present invention provides a transgenic plant, meaning a plant, or part thereof that has been transformed with a DNA construct comprising a polynucleotide operably linked to an operable promoter, for example, a homologous or heterologous promoter that is operable in the plant cell thus transformed. In some embodiments, the transformed polynucleotide encodes: a peptide comprising either a binary or a tertiary peptide, wherein the peptide contains at least 4 amino acids and up to a maximum of 16 amino acids, and is comprised of 2 or 3 different regions. The binary peptide has 2 different regions and the tertiary peptide has 3 different regions. The binary and tertiary peptide can be cleaved by both an animal, for example a human, gut protease and an insect or nematode gut protease. The binary or tertiary peptide is operably fused to the C-terminus of an Endoplasmic Reticulum Signal Peptide (ERSP) and operably fused to the N-terminus of a TP. In various embodiments, the plant cell is transformed with a DNA construct comprising at least one polynucleotide operably linked to an operable promoter, for example, a homologous or heterologous promoter, wherein the polynucleotide encodes an insecticidal and/or nematicidal protein having one or more cleavable binary or tertiary peptides. The insecticidal and/or nematicidal protein comprises an ERSP fused in frame with the N-terminus of the binary or tertiary peptide, and the binary or tertiary peptide is fused in frame with a construct comprising $(TP-L)_n$ wherein TP is toxic protein, L is a binary or tertiary peptide and n is an integer ranging from 1 to 200 and wherein the C-terminal TP is fused or unfused at its C-terminus with a binary or tertiary peptide. In some embodiments, the present invention provides a transgenic plant wherein the insecticidal and/or nematicidal protein that is expressed in the transgenic plant, or part thereof, is derived from a DNA construct that encodes an ERSP fused in frame with the N-terminus of the binary or tertiary peptide, and the binary or tertiary peptide is fused in frame with a construct comprising (TP-L), wherein TP is toxic protein, L is a binary or tertiary peptide and n is an integer ranging from 1 to 200 and wherein the C-terminal TP is fused or unfused at its C-terminus with a binary or tertiary peptide. In various embodiments, an exemplary insecticidal and/or nematicidal protein can include the structure: $(ERSP)-(TP-L)_n$, or $(ERSP)-(L)-(TP-L)_n$, or $(ERSP)-(L-TP)_n$, or $(ERSP)-(L-TP)_n-(L)$. In another embodiment, a plant, or part thereof comprises a polynucleotide operably linked to an operable promoter, for example, a homologous or heterologous promoter, wherein the polynucleotide encodes an insecticidal and/or nematicidal protein comprising an ERSP fused in frame with the N-terminus of a stabilizing domain (STA). The STA is fused in frame with either the N-terminus of a binary or tertiary peptide, or the N-terminus of a construct comprising: $(L-TP)_n$, $(L-TP)_n-L$, $(TP-L)_n$, or $L-(TP-L)_n$. In various embodiments, an exemplary insecticidal and/or nematicidal protein can include a construct from N-terminus to C-terminus comprising: (ERSP)-(L)-TP-(L)-TP, (ERSP)-(L)-TP-(L)-TP-(L), $(L-TP)_n-L$, $(L-TP-L)_n$, $(ERSP)-(TP-L)_n$, $(ERSP)-(L)-(TP-L)_n$, $(ERSP)-(L-TP)_n$, $(ERSP)-(L-TP)_n-(L)$, $(ERSP)-(STA)-(L-TP)_n$, $(ERSP)-(STA)-(L-TP)_n-(L)$, $(ERSP)-(STA)-(TP-L)_n$, or $(ERSP)-(STA)-(L)-(TP-L)_n$, or $(STA)-(L-TP)_n$, or $(STA)-(L-TP)_n-(L)$, or $(STA)-(TP-L)_n$, or $(STA)-(L)-(TP-L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide. In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs for example, selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1 b, or a hybrid-ACTX-Hv1a peptide, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In related embodiments, the transgenic plant expresses and produces an insecticidal and/or nematicidal protein containing one or more copies of a CRIP TP which may be derived from an Australian Funnel-web spider or sea anemone. In some embodiments, real or notional examples of transformed plants described and exemplified herein, are transformed with a CRIP TP from a spider selected from the Australian Funnel-web spiders of genus *Atrax* or *Hadronyche* or a sea anemone selected from *Anemonia viridis*. The transgenic plant can produce an insecticidal and/or nematicidal protein comprising one or more ICK TPs, for example, Hybrid-ACTX-Hv1a. The CRIP TP can be an ICK TP or Non-ICK TP that when expressed contains 20-100 amino acids and 2-4 disulfide bonds. The TPs useful in the transgenic peptides disclosed herein can have at least 50%, 55%, 60%, 65%, 70%, 75%, 80%, 85%, 90%, 95%, 96%, 97%, 98%, or 99% or greater sequence identity to SEQ ID NOs: 5 or 6, SEQ ID NO: 33-1032 and SEQ ID NO: 1761-1775 and variants thereof. In various embodiments, one or more of the CRIP TPs become active when the insecticidal and/or nematicidal protein's binary and/or tertiary peptides are cleaved by an appropriate protease found in the insect and/or nematode gut environment, thereby releasing the one or more TPs from the insecticidal and/or nematicidal protein to exert its insecticidal and/or nematicidal activity in the insect or nematode.

(6). Methods for Controlling a Pest Infection

In various embodiments of the present invention, methods are provided for controlling a pest infection or infestation (used interchangeably), wherein the pest may be an insect, a nematode or both. In some embodiments, the method for controlling such a pest infection includes providing in a diet of the pest, a plant, or part thereof, wherein the plant or part thereof, contains and expresses a polynucleotide which encodes an insecticidal and/or nematicidal TP as described herein. In other embodiments, a pesticidally effective amount of a composition comprising an insecticidal and/or nematicidal protein is applied to a plant, prior to the exposure to the pest, or during the pest infection or infestation, such that, the application of the insecticidal and/or nematicidal protein containing composition reduces the number of pests affecting the plant, or the severity of the pest infection on the plant thus contacted with the composition, and optionally enables the plant to survive and/or grow compared to similar plants exposed to the same pests in the absence of the composition.

In some embodiments, the plant expresses a polynucleotide which is operable to express an insecticidal and/or nematicidal protein constitutively, or inducibly. The polynucleotide may be operably linked to an operable promoter, for example, a homologous or heterologous promoter, wherein the polynucleotide encodes an insecticidal and/or nematicidal protein having one or more cleavable binary or tertiary peptides. The insecticidal and/or nematicidal protein can include the structure: (ERSP)-(TP-L)$_n$, or (ERSP)-(L)-(TP-L)$_n$, or (ERSP)-(L-TP)$_n$, or (ERSP)-(L-TP)$_n$-(L). In another embodiment, a plant, or part thereof comprises a polynucleotide operably linked to an operable promoter, for example, a homologous or heterologous promoter, wherein the polynucleotide encodes an insecticidal and/or nematicidal protein described herein, the insecticidal and/or nematicidal protein comprising an ERSP fused in frame with the N-terminus of a stabilizing domain (STA). The STA is fused in frame with either the N-terminus of a binary or tertiary peptide, or the N-terminus of a construct comprising: (L-TP)$_n$, (L-TP)$_n$-L, (TP-L)$_n$, or L-(TP-L)$_n$. In various embodiments, an exemplary insecticidal and/or nematicidal protein can comprise, or is selected from the group consisting of, or consists of: a construct from N-terminus to C-terminus: (ERSP)-(L)-TP-(L)-TP, (ERSP)-(L)-TP-(L)-TP-(L), (L-TP)$_n$-L, (L-TP-L)$_n$, (ERSP)-(TP-L)$_n$, (ERSP)-(L)-(TP-L)$_n$, (ERSP)-(L-TP)$_n$, (ERSP)-(L-TP)$_n$-(L), (ERSP)-(STA)-(L-TP)$_n$, (ERSP)-(STA)-(L-TP)$_n$-(L), (ERSP)-(STA)-(TP-L)$_n$, or (ERSP)-(STA)-(L)-(TP-L)$_n$, or (STA)-(L-TP)$_n$, or (STA)-(L-TP)$_n$-(L), or (STA)-(TP-L)$_n$, or (STA)-(L)-(TP-L)$_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different. In some embodiments, the C-terminal TP is fused or unfused at its C-terminus with a binary or tertiary peptide. The TPs useful in the above constructs disclosed above and herein can have at least 50%, 55%, 60%, 65%, 70%, 75%, 80%, 85%, 90%, 95%, 96%, 97%, 98%, or 99% or greater sequence identity to SEQ ID NOs: 5 or 6, SEQ ID NO: 33 and/or a TP selected from SEQ ID NOs: 33-1032 and variants thereof. In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b (wherein the TPs, if more than one, may be the same or different), or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT. In related embodiments, the method for controlling a pest infection provides expression and synthesis of an insecticidal and/or nematicidal protein in a plant or part thereof, for example, a plant tissue, a plant cell, and/or a plant seed. The insecticidal and/or nematicidal protein comprises one or more cleavable linker peptides fused in frame to one or more TPs. In some embodiments, the cleavable linker peptide is a binary peptide comprising an amino acid sequence of: $X_1$-$X_2$-$Y_1$-$Y_2$, $X_1$-$X_2$-$X_3$-$Y_1$-$Y_2$, $X_1$-$X_2$-$X_3$-$X_4$-$Y_1$-$Y_2$, $X_1$-$X_2$-$Y_1$-$Y_2$-$Y_3$, $X_1$-$X_2$-$X_3$-$Y_1$-$Y_2$-$Y_3$, $X_1$-$X_2$-$X_3$-$X_4$-$Y_1$-$Y_2$-$Y_3$, $X_1$-$X_2$-$Y_1$-$Y_2$-$Y_3$-$Y_4$, $X_1$-$X_2$-$X_3$-$Y_1$-$Y_2$-$Y_3$-$Y_4$, $X_1$-$X_2$-$X_3$-$X_4$-$Y_1$-$Y_2$-$Y_3$-$Y_4$, $Y_1$-$Y_2$-$X_1$-$X_2$, $Y_1$-$Y_2$-$X_1$-$X_2$-$X_3$, $Y_1$-$Y_2$-$X_1$-$X_2$-$X_3$-$X_4$, $Y_1$-$Y_2$-$Y_3$-$X_1$-$X_2$, $Y_1$-$Y_2$-$Y_3$-$X_1$-$X_2$-$X_3$, $Y_1$-$Y_2$-$Y_3$-$X_1$-$X_2$-$X_3$-$X_4$, $Y_1$-$Y_2$-$Y_3$-$Y_4$-$X_1$-$X_2$, $Y_1$-$Y_2$-$Y_3$-$Y_4$-$X_1$-$X_2$-$X_3$, $Y_1$-$Y_2$-$Y_3$-$Y_4$-$X_1$-$X_2$-$X_3$-$X_4$, wherein each $X_n$ and each $Y_n$ is an amino acid, and wherein each Xn and each Yn is an amino acid, and wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

In some embodiments, an illustrative insecticidal and/or nematicidal protein for use in a method to control a pest comprises one or more illustrative binary peptides (XY or YX). In some embodiments, the insecticidal and/or nematicidal protein comprises a cleavable binary peptide having the following amino acid sequence: AFVRLF (SEQ ID NO: 1594), AKLFV (SEQ ID NO: 1595), ALFALK (SEQ ID NO: 1596), ALFLK (SEQ ID NO: 1597), ALFLR (SEQ ID NO: 1598), ALFR (SEQ ID NO: 1599), ALFRLR (SEQ ID NO: 1600), ALKALF (SEQ ID NO: 1601), ALKFF (SEQ ID NO: 1602), ALKFLV (SEQ ID NO: 1603), ALKIFV (SEQ ID NO: 1604), ALKLFV (SEQ ID NO: 1605), FFADIK (SEQ ID NO: 1606), FFALK (SEQ ID NO: 1607), FFLK (SEQ ID NO: 1608), FFLR (SEQ ID NO: 1609), FFRLR (SEQ ID NO: 1610), FGYRIK (SEQ ID NO: 1611), FLRLF (SEQ ID NO: 1612), FYARR (SEQ ID NO: 1613), GGLRKK (SEQ ID NO: 1614), IFVALK (SEQ ID NO: 1615), IFVLK (SEQ ID NO: 1616), IFVLR (SEQ ID NO: 1617), IFVR (SEQ ID NO: 1618), IFVRLR (SEQ ID NO: 1619), ILFNIK (SEQ ID NO: 1620), LFAAPF (SEQ ID NO: 1621), FVALK (SEQ ID NO: 1622), LFVLK (SEQ ID NO: 1623), LFVLR (SEQ ID NO: 1624), LFVR (SEQ ID NO: 1625), LFVRLR (SEQ ID NO: 1626), LFVRVFL (SEQ ID NO: 1627), LGER (SEQ ID NO: 1628), LKALF (SEQ ID NO: 1629), LKFF (SEQ ID NO: 1630), LKIFV (SEQ ID NO: 1631), LKLFV (SEQ ID NO: 1632), LRALF (SEQ ID NO: 1633), LRFF (SEQ ID NO: 1634), LRIFV (SEQ ID NO: 1635), LRLFV (SEQ ID NO: 1636), RALF (SEQ ID NO: 1637), RIFV (SEQ ID NO: 1638), RLFV (SEQ ID NO: 1639), RLRALF (SEQ ID NO: 1640), RLRFF (SEQ ID NO: 1641), RLRIFV (SEQ ID NO: 1642), RLRLFV (SEQ ID NO: 1643), RRKAFV (SEQ ID NO: 1644), RRKLIF (SEQ ID NO: 1645), RRRFFA (SEQ ID NO: 1646), VFGRKG (SEQ ID NO: 1647), and YFVRK (SEQ ID NO: 1648).

In various embodiments, an illustrative insecticidal and/or nematicidal protein comprising a cleavable tertiary peptide having the following amino acid sequence construct: $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2-X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2-X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3-Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3-Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1-Y_2-Y_3-Y_4-Z_1$, $Z_1-X_1-X_2-Y_1-Y_2-Z_1$, $Z_1-X_1-X_2-X_3-Y_1-Y_2-Z_1$, $Z_1-X_1-X_2-X_3-X_4-Y_1-Y_2-Z_1$, $Z_1-X_1-X_2-Y_1-Y_2-Y_3-Z_1$, $Z_1-X_1-X_2-X_3-Y_1-Y_2-Y_3-Z_1$, $Z_1-X_1-X_2-X_3-X_4-Y_1-Y_2-Y_3-Z_1$, $Z_1-X_1-X_2-Y_1-Y_2-Y_3-Y_4-Z_1$, $Z_1-X_1-X_2-X_3-Y_1-Y_2-Y_3-Y_4-Z_1$, $Z_1-X_1-X_2-X_3-X_4-Y_1-Y_2-Y_3-Y_4-Z_1$, $Z_1-Z_2-X_1-X_2-Y_1-Y_2-Z_1$, $Z_1-Z_2-X_1-X_2-X_3-Y_1-Y_2-Z_1$, $Z_1-Z_2-X_1-X_2-X_3-X_4-Y_1-Y_2-Z_1$, $Z_1-Z_2-X_1-X_2-Y_1-Y_2-Y_3-Z_1$, $Z_1-Z_2-X_1-X_2-X_3-Y_1-Y_2-Y_3-Z_1$, $Z_1-Z_2-X_1-X_2-X_3-X_4-Y_1-Y_2-Y_3-Z_1$, $Z_1-Z_2-X_1-X_2-Y_1-Y_2-Y_3-Y_4-Z_1$, $Z_1-Z_2-X_1-X_2-X_3-Y_1-Y_2-Y_3-Y_4-Z_1$, $Z_1-Z_2-X_1-X_2-X_3-X_4-Y_1-Y_2-Y_3-Y_4-Z_1$, $Z_1-Z_2-Z_3-X_1-X_2-Y_1-Y_2-Z_1$, $Z_1-Z_2-Z_3-X_1-X_2-X_3-Y_1-Y_2-Z_1$, $Z_1-Z_2-Z_3-X_1-X_2-X_3-X_4-Y_1-Y_2-Z_1$, $Z_1-Z_2-Z_3-X_1-X_2-Y_1-Y_2-Y_3-Z_1$, $Z_1-Z_2-Z_3-X_1-X_2-X_3-Y_1-Y_2-Y_3-Z_1$, $Z_1-Z_2-Z_3-X_1-X_2-X_3-X_4-Y_1-Y_2-Y_3-Z_1$, $Z_1-Z_2-Z_3-X_1-X_2-Y_1-Y_2-Y_3-Y_4-Z_1$, $Z_1-Z_2-Z_3-X_1-X_2-X_3-Y_1-Y_2-Y_3-Y_4-Z_1$, $Z_1-Z_2-Z_3-X_1-X_2-X_3-X_4-Y_1-Y_2-Y_3-Y_4-Z_1$, $Z_1-Z_2-Z_3-Z_4-X_1-X_2-Y_1-Y_2-Z_1$, $Z_1-Z_2-Z_3-Z_4-X_1-X_2-X_3-Y_1-Y_2-Z_1$, $Z_1-Z_2-Z_3-Z_4-X_1-X_2-X_3-X_4-Y_1-Y_2-Z_1$, $Z_1-Z_2-Z_3-Z_4-X_1-X_2-Y_1-Y_2-Y_3-Z_1$, $Z_1-Z_2-Z_3-Z_4-X_1-X_2-X_3-Y_1-Y_2-Y_3-Z_1$, $Z_1-Z_2-Z_3-Z_4-X_1-X_2-X_3-X_4-Y_1-Y_2-Y_3-Z_1$, $Z_1-Z_2-Z_3-Z_4-X_1-X_2-Y_1-Y_2-Y_3-Y_4-Z_1$, $Z_1-Z_2-Z_3-Z_4-X_1-X_2-X_3-Y_1-Y_2-Y_3-Y_4-Z_1$, $Z_1-Z_2-Z_3-Z_4-X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $Z_1-X_1-X_2-Y_1-Y_2-Z_1-Z_2$, $Z_1-X_1-X_2-X_3-Y_1-Y_2-Z_1-Z_2$, $Z_1-X_1-X_2-X_3-X_4-Y_1-Y_2-Z_1-Z_2$, $Z_1-X_1-X_2-Y_1-Y_2-Y_3-Z_1-Z_2$, $Z_1-X_1-X_2-X_3-Y_1-Y_2-Y_3-Z_1-Z_2$, $Z_1-X_1-X_2-X_3-X_4-Y_1-Y_2-Y_3-Z_1-Z_2$, $Z_1-X_1-X_2-Y_1-Y_2-Y_3-Y_4-Z_1-Z_2$, $Z_1-X_1-X_2-X_3-Y_1-Y_2-Y_3-Y_4-Z_1-Z_2$, $Z_1-X_1-X_2-X_3-X_4-Y_1-Y_2-Y_3-Y_4-Z_1-Z_2$, $Z_1-Z_2-X_1-X_2-Y_1-Y_2-Z_1-Z_2$, $Z_1-Z_2-X_1-X_2-X_3-Y_1-Y_2-Z_1-Z_2$, $Z_1-Z_2-X_1-X_2-X_3-X_4-Y_1-Y_2-Z_1-Z_2$, $Z_1-Z_2-X_1-X_2-Y_1-Y_2-Y_3-Z_1-Z_2$, $Z_1-Z_2-X_1-X_2-X_3-Y_1-Y_2-Y_3-Z_1-Z_2$, $Z_1-Z_2-X_1-X_2-X_3-X_4-Y_1-Y_2-Y_3-Z_1-Z_2$, $Z_1-Z_2-X_1-X_2-Y_1-Y_2-Y_3-Y_4-Z_1-Z_2$, $Z_1-Z_2-X_1-X_2-X_3-Y_1-Y_2-Y_3-Y_4-Z_1-Z_2$, $Z_1-Z_2-X_1-X_2-X_3-X_4-Y_1-Y_2-Y_3-Y_4-Z_1-Z_2$, $Z_1-Z_2-Z_3-X_1-X_2-Y_1-Y_2-Z_1-Z_2$, $Z_1-Z_2-Z_3-X_1-X_2-X_3-Y_1-Y_2-Z_1-Z_2$, $Z_1-Z_2-Z_3-X_1-X_2-X_3-X_4-Y_1-Y_2-Z_1-Z_2$, $Z_1-Z_2-Z_3-X_1-X_2-Y_1-Y_2-Y_3-Z_1-Z_2$, $Z_1-Z_2-Z_3-X_1-X_2-X_3-Y_1-Y_2-Y_3-Z_1-Z_2$, $Z_1-Z_2-Z_3-X_1-X_2-X_3-X_4-Y_1-Y_2-Y_3-Z_1-Z_2$, $Z_1-Z_2-Z_3-X_1-X_2-Y_1-Y_2-Y_3-Y_4-Z_1-Z_2$, $Z_1-Z_2-Z_3-X_1-X_2-X_3-Y_1-Y_2-Y_3-Y_4-Z_1-Z_2$, $Z_1-Z_2-Z_3-X_1-X_2-X_3-X_4-Y_1-Y_2-Y_3-Y_4-Z_1-Z_2$, $Z_1-Z_2-Z_3-Z_4-X_1-X_2-Y_1-Y_2-Z_1-Z_2$, $Z_1-Z_2-Z_3-Z_4-X_1-X_2-X_3-Y_1-Y_2-Z_1-Z_2$, $Z_1-Z_2-Z_3-Z_4-X_1-X_2-X_3-X_4-Y_1-Y_2-Z_1-Z_2$, $Z_1-Z_2-Z_3-Z_4-X_1-X_2-Y_1-Y_2-Y_3-Z_1-Z_2$, $Z_1-Z_2-Z_3-Z_4-X_1-X_2-X_3-Y_1-Y_2-Y_3-Z_1-Z_2$, $Z_1-Z_2-Z_3-Z_4-X_1-X_2-X_3-X_4-Y_1-Y_2-Y_3-Z_1-Z_2$, $Z_1-Z_2-Z_3-Z_4-X_1-X_2-Y_1-Y_2-Y_3-Y_4-Z_1-Z_2$, $Z_1-Z_2-Z_3-Z_4-X_1-X_2-X_3-Y_1-Y_2-Y_3-Y_4-Z_1-Z_2$, $Z_1-Z_2-Z_3-Z_4-X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $Z_1-X_1-X_2-Y_1-Y_2-Z_1-Z_2-Z_3$, $Z_1-X_1-X_2-X_3-Y_1-Y_2-Z_1-Z_2-Z_3$, $Z_1-X_1-X_2-X_3-X_4-Y_1-Y_2-Z_1-Z_2-Z_3$, $Z_1-X_1-X_2-Y_1-Y_2-Y_3-Z_1-Z_2-Z_3$, $Z_1-X_1-X_2-X_3-Y_1-Y_2-Y_3-Z_1-Z_2-Z_3$, $Z_1-X_1-X_2-X_3-X_4-Y_1-Y_2-Y_3-Z_1-Z_2-Z_3$, $Z_1-X_1-X_2-Y_1-Y_2-Y_3-Y_4-Z_1-Z_2-Z_3$, $Z_1-X_1-X_2-X_3-Y_1-Y_2-Y_3-Y_4-Z_1-Z_2-Z_3$, $Z_1-X_1-X_2-X_3-X_4-Y_1-Y_2-Y_3-Y_4-Z_1-Z_2-Z_3$, $Z_1-Z_2-X_1-X_2-Y_1-Y_2-Z_1-Z_2-Z_3$, $Z_1-Z_2-X_1-X_2-X_3-Y_1-Y_2-Z_1-Z_2-Z_3$, $Z_1-Z_2-X_1-X_2-X_3-X_4-Y_1-Y_2-Z_1-Z_2-Z_3$, $Z_1-Z_2-X_1-X_2-Y_1-Y_2-Y_3-Z_1-Z_2-Z_3$, $Z_1-Z_2-X_1-X_2-X_3-Y_1-Y_2-Y_3-Z_1-Z_2-Z_3$, $Z_1-Z_2-X_1-X_2-X_3-X_4-Y_1-Y_2-Y_3-Z_1-Z_2-Z_3$, $Z_1-Z_2-X_1-X_2-Y_1-Y_2-Y_3-Y_4-Z_1-Z_2-Z_3$, $Z_1-Z_2-X_1-X_2-X_3-Y_1-Y_2-Y_3-Y_4-Z_1-Z_2-Z_3$, $Z_1-Z_2-X_1-X_2-X_3-X_4-Y_1-Y_2-Y_3-Y_4-Z_1-Z_2-Z_3$, $Z_1-Z_2-Z_3-X_1-X_2-Y_1-Y_2-Z_1-Z_2-Z_3$, $Z_1-Z_2-Z_3-X_1-X_2-X_3-Y_1-Y_2-Z_1-Z_2-Z_3$, $Z_1-Z_2-Z_3-X_1-X_2-X_3-X_4-Y_1-Y_2-Z_1-Z_2-Z_3$, $Z_1-Z_2-Z_3-X_1-X_2-Y_1-Y_2-Y_3-Z_1-Z_2-Z_3$, $Z_1-Z_2-Z_3-X_1-X_2-X_3-Y_1-Y_2-Y_3-Z_1-Z_2-Z_3$, $Z_1-Z_2-Z_3-X_1-X_2-X_3-X_4-Y_1-Y_2-Y_3-Z_1-Z_2-Z_3$, $Z_1-Z_2-Z_3-X_1-X_2-Y_1-Y_2-Y_3-Y_4-Z_1-Z_2-Z_3$, $Z_1-Z_2-Z_3-X_1-X_2-X_3-Y_1-Y_2-Y_3-Y_4-Z_1-Z_2-Z_3$, $Z_1-Z_2-Z_3-X_1-X_2-X_3-X_4-Y_1-Y_2-Y_3-Y_4-Z_1-Z_2-Z_3$, $Z_1-Z_2-Z_3-Z_4-X_1-X_2-Y_1-Y_2-Z_1-Z_2-Z_3$, $Z_1-Z_2-Z_3-Z_4-X_1-X_2-X_3-Y_1-Y_2-Z_1-Z_2-Z_3$, $Z_1-Z_2-Z_3-Z_4-X_1-X_2-X_3-X_4-Y_1-Y_2-Z_1-Z_2-Z_3$, $Z_1-Z_2-Z_3-Z_4-X_1-X_2-Y_1-Y_2-Y_3-Z_1-Z_2-Z_3$, $Z_1-Z_2-Z_3-Z_4-X_1-X_2-X_3-Y_1-Y_2-Y_3-Z_1-Z_2-Z_3$, $Z_1-Z_2-Z_3-Z_4-X_1-X_2-X_3-X_4-Y_1-Y_2-Y_3-Z_1-Z_2-Z_3$, $Z_1-Z_2-Z_3-Z_4-X_1-X_2-Y_1-Y_2-Y_3-Y_4-Z_1-Z_2-Z_3$, $Z_1-Z_2-Z_3-Z_4-X_1-X_2-X_3-Y_1-Y_2-Y_3-Y_4-Z_1-Z_2-Z_3$, $Z_1-Z_2-Z_3-Z_4-X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Z_1-X_1-X_2-Y_1-Y_2-Z_1-Z_2-Z_3-Z_4$, $Z_1-X_1-X_2-X_3-Y_1-Y_2-Z_1-Z_2-Z_3-Z_4$, $Z_1-X_1-X_2-X_3-X_4-Y_1-Y_2-Z_1-Z_2-Z_3-Z_4$, $Z_1-X_1-X_2-Y_1-Y_2-Y_3-Z_1-Z_2-Z_3-Z_4$, $Z_1-X_1-X_2-X_3-Y_1-Y_2-Y_3-Z_1-Z_2-Z_3-Z_4$, $Z_1-X_1-X_2-X_3-X_4-Y_1-Y_2-Y_3-Z_1-Z_2-Z_3-Z_4$, $Z_1-X_1-X_2-Y_1-Y_2-Y_3-Y_4-Z_1-Z_2-Z_3-Z_4$, $Z_1-X_1-X_2-X_3-Y_1-Y_2-Y_3-Y_4-Z_1-Z_2-Z_3-Z_4$, $Z_1-X_1-X_2-X_3-X_4-Y_1-Y_2-Y_3-Y_4-Z_1-Z_2-Z_3-Z_4$, $Z_1-Z_2-X_1-X_2-Y_1-Y_2-Z_1-Z_2-Z_3-Z_4$, $Z_1-Z_2-X_1-X_2-X_3-Y_1-Y_2-Z_1-Z_2-Z_3-Z_4$, $Z_1-Z_2-X_1-X_2-X_3-X_4-Y_1-Y_2-Z_1-Z_2-Z_3-Z_4$, $Z_1-Z_2-X_1-X_2-Y_1-Y_2-Y_3-Z_1-Z_2-Z_3-Z_4$, $Z_1-Z_2-X_1-X_2-X_3-Y_1-Y_2-Y_3-Z_1-Z_2-Z_3-Z_4$, $Z_1-Z_2-X_1-X_2-X_3-X_4-Y_1-Y_2-Y_3-Z_1-Z_2-Z_3-Z_4$, $Z_1-Z_2-X_1-X_2-Y_1-Y_2-Y_3-Y_4-Z_1-Z_2-Z_3-Z_4$, $Z_1-Z_2-X_1-X_2-X_3-Y_1-Y_2-Y_3-Y_4-Z_1-Z_2-Z_3-Z_4$, $Z_1-Z_2-X_1-X_2-X_3-X_4-Y_1-Y_2-Y_3-Y_4-Z_1-Z_2-Z_3-Z_4$, $Z_1-Z_2-Z_3-X_1-X_2-Y_1-Y_2-Z_1-Z_2-Z_3-Z_4$, $Z_1-Z_2-Z_3-X_1-X_2-X_3-Y_1-Y_2-Z_1-Z_2-Z_3-Z_4$, $Z_1-Z_2-Z_3-X_1-X_2-X_3-X_4-Y_1-Y_2-Z_1-Z_2-Z_3-Z_4$, $Z_1-Z_2-Z_3-X_1-X_2-Y_1-Y_2-Y_3-Z_1-Z_2-Z_3-Z_4$, $Z_1-Z_2-Z_3-X_1-X_2-X_3-Y_1-Y_2-Y_3-Z_1-Z_2-Z_3-Z_4$, $Z_1-Z_2-Z_3-X_1-X_2-X_3-X_4-Y_1-Y_2-Y_3-Z_1-Z_2-Z_3-Z_4$, $Z_1-Z_2-Z_3-X_1-X_2-Y_1-Y_2-Y_3-Y_4-Z_1-Z_2-Z_3-Z_4$, $Z_1-Z_2-Z_3-X_1-X_2-X_3-Y_1-Y_2-Y_3-Y_4-Z_1-Z_2-Z_3-Z_4$, $Z_1-Z_2-Z_3-X_1-X_2-X_3-X_4-Y_1-Y_2-Y_3-Y_4-Z_1-Z_2-Z_3-Z_4$, $Z_1-Z_2-Z_3-Z_4-X_1-X_2-Y_1-Y_2-Z_1-Z_2-Z_3-Z_4$, $Z_1-Z_2-Z_3-Z_4-X_1-X_2-X_3-Y_1-Y_2-Z_1-Z_2-Z_3-Z_4$, $Z_1-Z_2-Z_3-Z_4-X_1-X_2-X_3-X_4-Y_1-Y_2-Z_1-Z_2-Z_3-Z_4$, $Z_1-Z_2-Z_3-Z_4-X_1-X_2-Y_1-Y_2-Y_3-Z_1-Z_2-Z_3-Z_4$, $Z_1-Z_2-Z_3-Z_4-X_1-X_2-X_3-Y_1-Y_2-Y_3-Z_1-Z_2-Z_3-Z_4$, $Z_1-Z_2-Z_3-Z_4-X_1-X_2-X_3-X_4-Y_1-Y_2-Y_3-Z_1-Z_2-Z_3-Z_4$, $Z_1-Z_2-Z_3-Z_4-X_1-X_2-Y_1-Y_2-Y_3-Y_4-Z_1-Z_2-Z_3-Z_4$, $Z_1-Z_2-Z_3-Z_4-X_1-X_2-X_3-Y_1-Y_2-Y_3-Y_4-Z_1-Z_2-Z_3-Z_4$, $Z_1-Z_2-Z_3-Z_4-X_1-X_2-X_3-X_4-Y_1-Y_2-Y_3-Y_4-Z_1-Z_2-Z_3-Z_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Z_1-Y_1-Y_2-X_1-X_2-Z_1$, $Z_1-Y_1-Y_2-X_1-X_2-X_3-Z_1$, $Z_1-Y_1-Y_2-X_1-X_2-X_3-X_4-Z_1$, $Z_1-Y_1-Y_2-Y_3-X_1-X_2-Z_1$, $Z_1-Y_1-Y_2-Y_3-X_1-X_2-X_3-Z_1$, $Z_1-Y_1-Y_2-Y_3-X_1-X_2-X_3-X_4-Z_1$, $Z_1-Y_1-Y_2-Y_3-Y_4-X_1-X_2-Z_1$, $Z_1-Y_1-Y_2-Y_3-Y_4-X_1-X_2-X_3-Z_1$, $Z_1-Y_1-Y_2-Y_3-Y_4-X_1-X_2-X_3-X_4-Z_1$, $Z_1-Z_2-Y_1-Y_2-X_1-X_2-Z_1$, $Z_1-Z_2-Y_1-Y_2-X_1-X_2-X_3-Z_1$, $Z_1-Z_2-Y_1-Y_2-X_1-X_2-X_3-X_4-Z_1$, $Z_1-Z_2-Y_1-Y_2-Y_3-X_1-X_2-Z_1$, $Z_1-Z_2-Y_1-Y_2-Y_3-X_1-X_2-X_3-Z_1$, $Z_1-Z_2-Y_1-Y_2-Y_3-X_1-X_2-X_3-X_4-Z_1$, $Z_1-Z_2-Y_1-Y_2-Y_3-Y_4-X_1-X_2-Z_1$, $Z_1-Z_2-Y_1-Y_2-Y_3-Y_4-X_1-X_2-X_3-Z_1$, $Z_1-Z_2-Y_1-Y_2-Y_3-Y_4-X_1-X_2-X_3-X_4-Z_1$, $Z_1-Z_2-Z_3-Y_1-Y_2-X_1-X_2-Z_1$, $Z_1-Z_2-Z_3-Y_1-Y_2-X_1-X_2-X_3-Z_1$, $Z_1-Z_2-Z_3-Y_1-Y_2-X_1-X_2-X_3-X_4-Z_1$, $Z_1-Z_2-Z_3-Y_1-Y_2-Y_3-X_1-X_2-Z_1$, $Z_1-Z_2-Z_3-Y_1-Y_2-Y_3-X_1-X_2-X_3-Z_1$, $Z_1-Z_2-Z_3-Y_1-Y_2-Y_3-X_1-X_2-X_3-X_4-Z_1$, $Z_1-Z_2-Z_3-Y_1-Y_2-Y_3-Y_4-X_1-X_2-Z_1$, $Z_1-Z_2-Z_3-Y_1-Y_2-Y_3-Y_4-X_1-X_2-X_3-Z_1$, $Z_1-Z_2-Z_3-Y_1-Y_2-Y_3-Y_4-X_1-X_2-X_3-X_4-Z_1$, $Z_1-Z_2-Z_3-Z_4-Y_1-Y_2-X_1-X_2-Z_1$, $Z_1-Z_2-Z_3-Z_4-Y_1-Y_2-X_1-X_2-X_3-Z_1$, $Z_1-Z_2-Z_3-Z_4-Y_1-Y_2-X_1-X_2-X_3-X_4-Z_1$, $Z_1-Z_2-Z_3-Z_4-Y_1-Y_2-Y_3-X_1-X_2-Z_1$, $Z_1-Z_2-Z_3-Z_4-Y_1-Y_2-Y_3-X_1-X_2-X_3-Z_1$, $Z_1-Z_2-Z_3-Z_4-Y_1-Y_2-Y_3-X_1-X_2-X_3-X_4-Z_1$, $Z_1-Z_2-Z_3-Z_4-Y_1-Y_2-Y_3-Y_4-X_1-X_2-Z_1$, $Z_1-Z_2-Z_3-Z_4-Y_1-Y_2-Y_3-Y_4-X_1-X_2-X_3-Z_1$, $Z_1-Z_2-Z_3-Z_4-Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Z_1-Y_1-Y_2-X_1-X_2-Z_1-Z_2$, $Z_1-Y_1-Y_2-X_1-X_2-X_3-Z_1-Z_2$, $Z_1-Y_1-Y_2-X_1-X_2-X_3-X_4-Z_1-Z_2$, $Z_1-Y_1-Y_2-Y_3-X_1-X_2-Z_1-Z_2$, $Z_1-Y_1-Y_2-Y_3-X_1-X_2-X_3-Z_1-Z_2$, $Z_1-Y_1-Y_2-Y_3-X_1-X_2-X_3-X_4-Z_1-Z_2$, $Z_1-Y_1-Y_2-Y_3-Y_4-X_1-X_2-Z_1-Z_2$, $Z_1-Y_1-Y_2-Y_3-Y_4-X_1-X_2-X_3-Z_1-Z_2$, $Z_1-Y_1-Y_2-Y_3-Y_4-X_1-X_2-X_3-X_4-Z_1-Z_2$, $Z_1-Z_2-Y_1-Y_2-X_1-X_2-Z_1-Z_2$, $Z_1-Z_2-Y_1-Y_2-X_1-X_2-X_3-Z_1-Z_2$, $Z_1-Z_2-Y_1-Y_2-X_1-X_2-X_3-X_4-Z_1-Z_2$, $Z_1-Z_2-Y_1-Y_2-Y_3-X_1-X_2-Z_1-Z_2$, $Z_1-Z_2-Y_1-Y_2-Y_3-X_1-X_2-X_3-Z_1-Z_2$, $Z_1-Z_2-Y_1-Y_2-Y_3-X_1-X_2-X_3-X_4-Z_1-Z_2$, $Z_1-Z_2-Y_1-Y_2-Y_3-Y_4-X_1-X_2-Z_1-Z_2$, $Z_1-Z_2-Y_1-Y_2-Y_3-Y_4-X_1-X_2-X_3-Z_1-Z_2$, $Z_1-Z_2-Y_1-Y_2-Y_3-Y_4-X_1-X_2-X_3-X_4-Z_1-Z_2$, $Z_1-Z_2-Z_3-Y_1-Y_2-X_1-X_2-Z_1-Z_2$, $Z_1-Z_2-Z_3-Y_1-Y_2-X_1-X_2-X_3-Z_1-Z_2$, $Z_1-Z_2-Z_3-Y_1-Y_2-X_1-X_2-X_3-X_4-Z_1-Z_2$, $Z_1-Z_2-Z_3-Y_1-Y_2-Y_3-X_1-X_2-Z_1-Z_2$, $Z_1-Z_2-Z_3-Y_1-Y_2-Y_3-X_1-X_2-X_3-Z_1-Z_2$, $Z_1-Z_2-Z_3-Y_1-Y_2-Y_3-X_1-X_2-X_3-X_4-Z_1-Z_2$, $Z_1-Z_2-Z_3-Y_1-Y_2-Y_3-Y_4-X_1-X_2-X_3-Z_1-Z_2$, $Z_1-Z_2-Z_3-Y_1-Y_2-Y_3-Y_4-X_1-X_2-X_3-Z_1-Z_2$, $Z_1-Z_2-Z_3-Y_1-Y_2-Y_3-Y_4-X_1-X_2-X_3-X_4-Z_1-Z_2$, $Z_1-Z_2-Z_3-Z_4-Y_1-Y_2-X_1-X_2-Z_1-Z_2$, $Z_1-Z_2-Z_3-Z_4-Y_1-Y_2-X_1-X_2-X_3-Z_1-Z_2$, $Z_1-Z_2-Z_3-Z_4-Y_1-Y_2-X_1-X_2-X_3-X_4-Z_1-Z_2$, $Z_1-Z_2-Z_3-Z_4-Y_1-Y_2-Y_3-X_1-X_2-Z_1-Z_2$, $Z_1-Z_2-Z_3-Z_4-Y_1-Y_2-Y_3-X_1-X_2-X_3-Z_1-Z_2$, $Z_1-Z_2-Z_3-Z_4-Y_1-Y_2-Y_3-X_1-X_2-X_3-X_4-Z_1-Z_2$, $Z_1-Z_2-Z_3-Z_4-Y_1-Y_2-Y_3-Y_4-X_1-X_2-Z_1-Z_2$, $Z_1-Z_2-Z_3-Z_4-Y_1-Y_2-Y_3-Y_4-X_1-X_2-X_3-Z_1-Z_2$, $Z_1-Z_2-Z_3-Z_4-Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Z_1-Y_1-Y_2-X_1-X_2-Z_1-Z_2-Z_3$, $Z_1-Y_1-Y_2-X_1-X_2-X_3-Z_1-Z_2-Z_3$, $Z_1-Y_1-Y_2-X_1-X_2-X_3-X_4-Z_1-Z_2-Z_3$, $Z_1-Y_1-Y_2-Y_3-X_1-X_2-Z_1-Z_2-Z_3$, $Z_1-Y_1-Y_2-Y_3-X_1-X_2-X_3-Z_1-Z_2-Z_3$, $Z_1-Y_1-Y_2-Y_3-X_1-X_2-X_3-X_4-Z_1-Z_2-Z_3$, $Z_1-Y_1-Y_2-Y_3-Y_4-X_1-X_2-Z_1-Z_2-Z_3$, $Z_1-Y_1-Y_2-Y_3-Y_4-X_1-X_2-X_3-Z_1-Z_2-Z_3$, $Z_1-Y_1-Y_2-Y_3-Y_4-X_1-X_2-X_3-X_4-Z_1-Z_2-Z_3$, $Z_1-Z_2-Y_1-Y_2-X_1-X_2-Z_1-Z_2-Z_3$, $Z_1-Z_2-Y_1-Y_2-X_1-X_2-X_3-Z_1-Z_2-Z_3$, $Z_1-Z_2-Y_1-Y_2-X_1-X_2-X_3-X_4-Z_1-Z_2-Z_3$, $Z_1-Z_2-Y_1-Y_2-Y_3-X_1-X_2-Z_1-Z_2-Z_3$, $Z_1-Z_2-Y_1-Y_2-Y_3-X_1-X_2-X_3-Z_1-Z_2-Z_3$, $Z_1-Z_2-Y_1-Y_2-Y_3-X_1-X_2-X_3-X_4-Z_1-Z_2-Z_3$, $Z_1-Z_2-Y_1-Y_2-Y_3-Y_4-X_1-X_2-Z_1-Z_2-Z_3$, $Z_1-Z_2-Y_1-Y_2-Y_3-Y_4-X_1-X_2-X_3-Z_1-$ $Z_2-Z_3$, $Z_1-Z_2-Y_1-Y_2-Y_3-Y_4-X_1-X_2-X_3-X_4-Z_1-Z_2-Z_3$, $Z_1-Z_2-Z_3-Y_1-Y_2-X_1-X_2-Z_1-Z_2-Z_3$, $Z_1-Z_2-Z_3-Y_1-Y_2-X_1-X_2-X_3-Z_1-Z_2-Z_3$, $Z_1-Z_2-Z_3-Y_1-Y_2-X_1-X_2-X_3-X_4-Z_1-Z_2-Z_3$, $Z_1-Z_2-Z_3-Y_1-Y_2-Y_3-X_1-X_2-Z_1-Z_2-Z_3$, $Z_1-Z_2-Z_3-Y_1-Y_2-Y_3-X_1-X_2-X_3-Z_1-Z_2-Z_3$, $Z_1-Z_2-Z_3-Y_1-Y_2-Y_3-X_1-X_2-X_3-X_4-Z_1-Z_2-Z_3$, $Z_1-Z_2-Z_3-Y_1-Y_2-Y_3-Y_4-X_1-X_2-Z_1-Z_2-Z_3$, $Z_1-Z_2-Z_3-Y_1-Y_2-Y_3-Y_4-X_1-X_2-X_3-Z_1-Z_2-Z_3$, $Z_1-Z_2-Z_3-Y_1-Y_2-Y_3-Y_4-X_1-X_2-X_3-X_4-Z_1-Z_2-Z_3$, $Z_1-Z_2-Z_3-Z_4-Y_1-Y_2-X_1-X_2-Z_1-Z_2-Z_3$, $Z_1-Z_2-Z_3-Z_4-Y_1-Y_2-X_1-X_2-X_3-Z_1-Z_2-Z_3$, $Z_1-Z_2-Z_3-Z_4-Y_1-Y_2-X_1-X_2-X_3-X_4-Z_1-Z_2-Z_3$, $Z_1-Z_2-Z_3-Z_4-Y_1-Y_2-Y_3-X_1-X_2-Z_1-Z_2-Z_3$, $Z_1-Z_2-Z_3-Z_4-Y_1-Y_2-Y_3-X_1-X_2-X_3-Z_1-Z_2-Z_3$, $Z_1-Z_2-Z_3-Z_4-Y_1-Y_2-Y_3-X_1-X_2-X_3-X_4-Z_1-Z_2-Z_3$, $Z_1-Z_2-Z_3-Z_4-Y_1-Y_2-Y_3-Y_4-X_1-X_2-Z_1-Z_2-Z_3$, $Z_1-Z_2-Z_3-Z_4-Y_1-Y_2-Y_3-Y_4-X_1-X_2-X_3-Z_1-Z_2-Z_3$, $Z_1-Z_2-Z_3-Z_4-Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-Y_1-Y_2-X_1-X_2-Z_1-Z_2-Z_3-Z_4$, $Z_1-Y_1-Y_2-X_1-X_2-X_3-Z_1-Z_2-Z_3-Z_4$, $Z_1-Y_1-Y_2-X_1-X_2-X_3-X_4-Z_1-Z_2-Z_3-Z_4$, $Z_1-Y_1-Y_2-Y_3-X_1-X_2-Z_1-Z_2-Z_3-Z_4$, $Z_1-Y_1-Y_2-Y_3-X_1-X_2-X_3-Z_1-Z_2-Z_3-Z_4$, $Z_1-Y_1-Y_2-Y_3-X_1-X_2-X_3-X_4-Z_1-Z_2-Z_3-Z_4$, $Z_1-Y_1-Y_2-Y_3-Y_4-X_1-X_2-Z_1-Z_2-Z_3-Z_4$, $Z_1-Y_1-Y_2-Y_3-Y_4-X_1-X_2-X_3-Z_1-Z_2-Z_3-Z_4$, $Z_1-Y_1-Y_2-Y_3-Y_4-X_1-X_2-X_3-X_4-Z_1-Z_2-Z_3-Z_4$, $Z_1-Z_2-Y_1-Y_2-X_1-X_2-Z_1-Z_2-Z_3-Z_4$, $Z_1-Z_2-Y_1-Y_2-X_1-X_2-X_3-Z_1-Z_2-Z_3-Z_4$, $Z_1-Z_2-Y_1-Y_2-X_1-X_2-X_3-X_4-Z_1-Z_2-Z_3-Z_4$, $Z_1-Z_2-Y_1-Y_2-Y_3-X_1-X_2-Z_1-Z_2-Z_3-Z_4$, $Z_1-Z_2-Y_1-Y_2-Y_3-X_1-X_2-X_3-Z_1-Z_2-Z_3-Z_4$, $Z_1-Z_2-Y_1-Y_2-Y_3-X_1-X_2-X_3-X_4-Z_1-Z_2-Z_3-Z_4$, $Z_1-Z_2-Y_1-Y_2-Y_3-Y_4-X_1-X_2-Z_1-Z_2-Z_3-Z_4$, $Z_1-Z_2-Y_1-Y_2-Y_3-Y_4-X_1-X_2-X_3-Z_1-Z_2-Z_3-Z_4$, $Z_1-Z_2-Y_1-Y_2-Y_3-Y_4-X_1-X_2-X_3-X_4-Z_1-Z_2-Z_3-Z_4$, $Z_1-Z_2-Z_3-Y_1-Y_2-X_1-X_2-Z_1-Z_2-Z_3-Z_4$, $Z_1-Z_2-Z_3-Y_1-Y_2-X_1-X_2-X_3-Z_1-Z_2-Z_3-Z_4$, $Z_1-Z_2-Z_3-Y_1-Y_2-X_1-X_2-X_3-X_4-Z_1-Z_2-Z_3-Z_4$, $Z_1-Z_2-Z_3-Y_1-Y_2-Y_3-X_1-X_2-Z_1-Z_2-Z_3-Z_4$, $Z_1-Z_2-Z_3-Y_1-Y_2-Y_3-X_1-X_2-X_3-Z_1-Z_2-Z_3-Z_4$, $Z_1-Z_2-Z_3-Y_1-Y_2-Y_3-X_1-X_2-X_3-X_4-Z_1-Z_2-Z_3-Z_4$, $Z_1-Z_2-Z_3-Y_1-Y_2-Y_3-Y_4-X_1-X_2-Z_1-Z_2-Z_3-Z_4$, $Z_1-Z_2-Z_3-Y_1-Y_2-Y_3-Y_4-X_1-X_2-X_3-Z_1-Z_2-Z_3-Z_4$, $Z_1-Z_2-Z_3-Y_1-Y_2-Y_3-Y_4-X_1-X_2-X_3-X_4-Z_1-Z_2-Z_3-Z_4$, $Z_1-Z_2-Z_3-Z_4-Y_1-Y_2-X_1-X_2-Z_1-Z_2-Z_3-Z_4$, $Z_1-Z_2-Z_3-Z_4-Y_1-Y_2-X_1-X_2-X_3-Z_1-Z_2-Z_3-Z_4$, $Z_1-Z_2-Z_3-Z_4-Y_1-Y_2-X_1-X_2-X_3-X_4-Z_1-Z_2-Z_3-Z_4$, $Z_1-Z_2-Z_3-Z_4-Y_1-Y_2-Y_3-X_1-X_2-Z_1-Z_2-Z_3-Z_4$, $Z_1-Z_2-Z_3-Z_4-Y_1-Y_2-Y_3-X_1-X_2-X_3-Z_1-Z_2-Z_3-Z_4$, $Z_1-Z_2-Z_3-Z_4-Y_1-Y_2-Y_3-X_1-X_2-X_3-X_4-Z_1-Z_2-Z_3-Z_4$, $Z_1-Z_2-Z_3-Z_4-Y_1-Y_2-Y_3-Y_4-X_1-X_2-Z_1-Z_2-Z_3-Z_4$, $Z_1-Z_2-Z_3-Z_4-Y_1-Y_2-Y_3-Y_4-X_1-X_2-X_3-Z_1-Z_2-Z_3-Z_4$, $Z_1-Z_2-Z_3-Z_4-Y_1-Y_2-Y_3-Y_4-X_1-X_2-X_3-X_4-Z_1-Z_2-Z_3-Z_4$, $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2-X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2-X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3-Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3-Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-X_1-X_2-Y_1-Y_2$, $Z_1-X_1-X_2-X_3-Y_1-Y_2$, $Z_1-X_1-X_2-X_3-X_4-Y_1-Y_2$, $Z_1-X_1-X_2-Y_1-Y_2-Y_3$, $Z_1-X_1-X_2-X_3-Y_1-Y_2-Y_3$, $Z_1-X_1-X_2-X_3-X_4-Y_1-Y_2-Y_3$, $Z_1-X_1-X_2-Y_1-Y_2-Y_3-Y_4$, $Z_1-X_1-X_2-X_3-Y_1-Y_2-Y_3-Y_4$, $Z_1-X_1-X_2-X_3-X_4-Y_1-Y_2-Y_3-Y_4$, $Z_1-Z_2-X_1-X_2-Y_1-Y_2$, $Z_1-Z_2-X_1-X_2-X_3-Y_1-Y_2$, $Z_1-Z_2-X_1-X_2-X_3-X_4-Y_1-Y_2$, $Z_1-Z_2-X_1-X_2-Y_1-Y_2-Y_3$, $Z_1-Z_2-X_1-X_2-X_3-Y_1-Y_2-Y_3$, $Z_1-Z_2-X_1-X_2-X_3-X_4-Y_1-Y_2-Y_3$, $Z_1-Z_2-X_1-X_2-Y_1-Y_2-Y_3-Y_4$, $Z_1-Z_2-X_1-X_2-X_3-Y_1-Y_2-Y_3-Y_4$, $Z_1-Z_2-X_1-X_2-X_3-X_4-Y_1-Y_2-Y_3-Y_4$, $Z_1-Z_2-Z_3-X_1-X_2-Y_1-Y_2$, $Z_1-Z_2-Z_3-X_1-X_2-X_3-Y_1-Y_2$, $Z_1-Z_2-Z_3-X_1-X_2-X_3-X_4-Y_1-Y_2$, $Z_1-Z_2-Z_3-X_1-X_2-Y_1-Y_2-Y_3$, $Z_1-Z_2-Z_3-X_1-X_2-X_3-Y_1-Y_2-Y_3$, $Z_1-Z_2-Z_3-X_1-X_2-X_3-X_4-Y_1-Y_2-Y_3$, $Z_1-Z_2-Z_3-X_1-X_2-Y_1-Y_2-Y_3-Y_4$, $Z_1-Z_2-Z_3-X_1-X_2-X_3-Y_1-Y_2-Y_3-Y_4$, $Z_1-Z_2-Z_3-X_1-X_2-X_3-X_4-Y_1-Y_2-Y_3-Y_4$, $Z_1-Z_2-Z_3-Z_4-X_1-X_2-Y_1-Y_2$, $Z_1-Z_2-Z_3-Z_4-X_1-X_2-X_3-Y_1-Y_2$, $Z_1-Z_2-Z_3-Z_4-X_1-X_2-X_3-X_4-Y_1-Y_2$, $Z_1-Z_2-Z_3-Z_4-X_1-X_2-Y_1-Y_2-Y_3$, $Z_1-Z_2-Z_3-Z_4-X_1-X_2-X_3-Y_1-Y_2-Y_3$, $Z_1-Z_2-Z_3-Z_4-X_1-X_2-X_3-X_4-Y_1-Y_2-Y_3$, $Z_1-Z_2-Z_3-Z_4-X_1-X_2-Y_1-Y_2-Y_3-Y_4$, $Z_1-Z_2-Z_3-Z_4-X_1-X_2-X_3-Y_1-Y_2-Y_3-Y_4$, $Z_1-Z_2-Z_3-Z_4-X_1-X_2-X_3-X_4-Y_1-Y_2-Y_3-Y_4$, $X_1-X_2-Y_1-Y_2-Z_1$, $X_1-X_2-X_3-Y_1-Y_2-Z_1$, $X_1-X_2-X_3-X_4-Y_1-Y_2-Z_1$, $X_1-X_2-Y_1-Y_2-Y_3-Z_1$, $X_1-X_2-X_3-Y_1-Y_2-Y_3-Z_1$, $X_1-X_2-X_3-X_4-Y_1-Y_2-Y_3-Z_1$, $X_1-X_2-Y_1-Y_2-Y_3-Y_4-Z_1$, $X_1-X_2-X_3-Y_1-Y_2-Y_3-Y_4-Z_1$, $X_1-X_2-X_3-X_4-Y_1-Y_2-Y_3-Y_4-Z_1$, $Z_1-X_1-X_2-Y_1-Y_2-Z_1$, $Z_1-X_1-X_2-X_3-Y_1-Y_2-Z_1$, $Z_1-X_1-X_2-X_3-X_4-Y_1-Y_2-Z_1$, $Z_1-X_1-X_2-Y_1-Y_2-Y_3-Z_1$, $Z_1-X_1-X_2-X_3-Y_1-Y_2-Y_3-Z_1$, $Z_1-X_1-X_2-X_3-X_4-Y_1-Y_2-Y_3-Z_1$, $Z_1-X_1-X_2-Y_1-Y_2-Y_3-Y_4-Z_1$, $Z_1-X_1-X_2-X_3-Y_1-Y_2-Y_3-Y_4-Z_1$, $Z_1-X_1-X_2-X_3-X_4-Y_1-Y_2-Y_3-Y_4-Z_1$, $Z_1-Z_2-X_1-X_2-Y_1-Y_2-Z_1$, $Z_1-Z_2-X_1-X_2-X_3-Y_1-Y_2-Z_1$, $Z_1-Z_2-X_1-X_2-X_3-X_4-Y_1-Y_2-Z_1$, $Z_1-Z_2-X_1-X_2-Y_1-Y_2-Y_3-Z_1$, $Z_1-Z_2-X_1-X_2-X_3-Y_1-Y_2-Y_3-Z_1$, $Z_1-Z_2-X_1-X_2-X_3-X_4-Y_1-Y_2-Y_3-Z_1$, $Z_1-Z_2-X_1-X_2-Y_1-Y_2-Y_3-Y_4-Z_1$, $Z_1-Z_2-X_1-X_2-X_3-Y_1-Y_2-Y_3-Y_4-Z_1$, $Z_1-Z_2-X_1-X_2-X_3-X_4-Y_1-Y_2-Y_3-Y_4-Z_1$, $Z_1-Z_2-Z_3-X_1-X_2-Y_1-Y_2-Z_1$, $Z_1-Z_2-Z_3-X_1-X_2-X_3-Y_1-Y_2-Z_1$, $Z_1-Z_2-Z_3-X_1-X_2-X_3-X_4-Y_1-Y_2-Z_1$, $Z_1-Z_2-Z_3-X_1-X_2-Y_1-Y_2-Y_3-Z_1$, $Z_1-Z_2-Z_3-X_1-X_2-X_3-Y_1-Y_2-Y_3-Z_1$, $Z_1-Z_2-Z_3-X_1-X_2-X_3-X_4-Y_1-Y_2-Y_3-Z_1$, $Z_1-Z_2-Z_3-X_1-X_2-Y_1-Y_2-Y_3-Y_4-Z_1$, $Z_1-Z_2-Z_3-X_1-X_2-X_3-Y_1-Y_2-Y_3-Y_4-Z_1$, $Z_1-Z_2-Z_3-X_1-X_2-X_3-X_4-Y_1-Y_2-Y_3-Y_4-Z_1$, $Z_1-Z_2-Z_3-Z_4-X_1-X_2-Y_1-Y_2-Z_1$, $Z_1-Z_2-Z_3-Z_4-X_1-X_2-X_3-Y_1-Y_2-Z_1$, $Z_1-Z_2-Z_3-Z_4-X_1-X_2-X_3-X_4-Y_1-Y_2-Z_1$, $Z_1-Z_2-Z_3-Z_4-X_1-X_2-Y_1-Y_2-Y_3-Z_1$, $Z_1-Z_2-Z_3-Z_4-X_1-X_2-X_3-Y_1-Y_2-Y_3-Z_1$, $Z_1-Z_2-Z_3-Z_4-X_1-X_2-X_3-X_4-Y_1-Y_2-Y_3-Z_1$, $Z_1-Z_2-Z_3-Z_4-X_1-X_2-Y_1-Y_2-Y_3-Y_4-Z_1$, $Z_1-Z_2-Z_3-Z_4-X_1-X_2-X_3-Y_1-Y_2-Y_3-Y_4-Z_1$, $Z_1-Z_2-Z_3-Z_4-X_1-X_2-X_3-X_4-Y_1-Y_2-Y_3-Y_4-Z_1$, $X_1-X_2-Y_1-Y_2-Z_1-Z_2$, $X_1-X_2-X_3-Y_1-Y_2-Z_1-Z_2$, $X_1-X_2-X_3-X_4-Y_1-Y_2-Z_1-Z_2$, $X_1-X_2-Y_1-Y_2-Y_3-Z_1-Z_2$, $X_1-X_2-X_3-Y_1-Y_2-Y_3-Z_1-Z_2$, $X_1-X_2-X_3-X_4-Y_1-Y_2-Y_3-Z_1-Z_2$, $X_1-X_2-Y_1-Y_2-Y_3-Y_4-Z_1-Z_2$, $X_1-X_2-X_3-Y_1-Y_2-Y_3-Y_4-Z_1-Z_2$, $X_1-X_2-X_3-X_4-Y_1-Y_2-Y_3-Y_4-Z_1-Z_2$, $Z_1-X_1-X_2-Y_1-Y_2-Z_1-Z_2$, $Z_1-X_1-X_2-X_3-Y_1-Y_2-Z_1-Z_2$, $Z_1-X_1-X_2-X_3-X_4-Y_1-Y_2-Z_1-Z_2$, $Z_1-X_1-X_2-Y_1-Y_2-Y_3-Z_1-Z_2$, $Z_1-X_1-X_2-X_3-Y_1-Y_2-Y_3-Z_1-Z_2$, $Z_1-X_1-X_2-X_3-X_4-Y_1-Y_2-Y_3-Z_1-Z_2$, $Z_1-X_1-X_2-Y_1-Y_2-Y_3-Y_4-Z_1-Z_2$, $Z_1-X_1-X_2-X_3-Y_1-Y_2-Y_3-Y_4-Z_1-Z_2$, $Z_1-X_1-X_2-X_3-X_4-Y_1-Y_2-Y_3-Y_4-Z_1-Z_2$, $Z_1-Z_2-X_1-X_2-Y_1-Y_2-Z_1-Z_2$, $Z_1-Z_2-X_1-X_2-X_3-Y_1-Y_2-Z_1-Z_2$, $Z_1-Z_2-X_1-X_2-X_3-X_4-Y_1-Y_2-Z_1-Z_2$, $Z_1-Z_2-X_1-X_2-Y_1-Y_2-Y_3-Z_1-Z_2$, $Z_1-Z_2-X_1-X_2-X_3-Y_1-Y_2-Y_3-Z_1-Z_2$, $Z_1-Z_2-X_1-X_2-X_3-X_4-Y_1-Y_2-Y_3-Z_1-Z_2$, $Z_1-Z_2-X_1-X_2-Y_1-Y_2-Y_3-Y_4-Z_1-Z_2$, $Z_1-Z_2-X_1-X_2-X_3-Y_1-Y_2-Y_3-Y_4-Z_1-Z_2$, $Z_1-Z_2-X_1-X_2-X_3-X_4-Y_1-Y_2-Y_3-Y_4-Z_1-Z_2$, $Z_1-Z_2-Z_3-X_1-X_2-Y_1-Y_2-Z_1-Z_2$, $Z_1-Z_2-Z_3-X_1-X_2-X_3-Y_1-Y_2-Z_1-Z_2$, $Z_1-Z_2-Z_3-X_1-X_2-X_3-X_4-Y_1-Y_2-Z_1-Z_2$, $Z_1-Z_2-Z_3-X_1-X_2-Y_1-Y_2-Y_3-Z_1-Z_2$, $Z_1-Z_2-Z_3-X_1-X_2-X_3-Y_1-Y_2-Y_3-Z_1-Z_2$, $Z_1-Z_2-Z_3-X_1-X_2-X_3-X_4-Y_1-Y_2-Y_3-Z_1-Z_2$, $Z_1-Z_2-Z_3-X_1-X_2-Y_1-Y_2-Y_3-Y_4-Z_1-Z_2$, $Z_1-Z_2-Z_3-X_1-X_2-X_3-Y_1-Y_2-Y_3-Y_4-Z_1-Z_2$, $Z_1-Z_2-Z_3-X_1-X_2-X_3-X_4-Y_1-Y_2-Y_3-Y_4-Z_1-Z_2$, $Z_1-Z_2-Z_3-Z_4-X_1-X_2-Y_1-Y_2-Z_1-Z_2$, $Z_1-Z_2-Z_3-Z_4-X_1-X_2-X_3-Y_1-Y_2-Z_1-Z_2$, $Z_1-Z_2-Z_3-Z_4-X_1-X_2-X_3-X_4-Y_1-Y_2-Z_1-Z_2$, $Z_1-Z_2-Z_3-Z_4-X_1-X_2-Y_1-Y_2-Y_3-Z_1-Z_2$, $Z_1-Z_2-Z_3-Z_4-X_1-X_2-X_3-Y_1-Y_2-Y_3-Z_1-Z_2$, $Z_1-Z_2-Z_3-Z_4-X_1-X_2-X_3-X_4-Y_1-Y_2-Y_3-Z_1-Z_2$, $Z_1-Z_2-Z_3-Z_4-X_1-X_2-Y_1-Y_2-Y_3-Y_4-Z_1-Z_2$, $Z_1-Z_2-Z_3-Z_4-X_1-X_2-X_3-Y_1-Y_2-Y_3-Y_4-Z_1-Z_2$, $Z_1-Z_2-Z_3-Z_4-X_1-X_2-X_3-X_4-Y_1-Y_2-Y_3-Y_4-Z_1-Z_2$, $X_1-X_2-Y_1-Y_2-Z_1-Z_2-Z_3$, $X_1-X_2-X_3-Y_1-Y_2-Z_1-Z_2-Z_3$, $X_1-X_2-X_3-X_4-Y_1-Y_2-Z_1-Z_2-Z_3$, $X_1-X_2-Y_1-Y_2-Y_3-Z_1-Z_2-Z_3$, $X_1-X_2-X_3-Y_1-Y_2-Y_3-Z_1-Z_2-Z_3$, $X_1-X_2-X_3-X_4-Y_1-Y_2-Y_3-Z_1-Z_2-Z_3$, $X_1-X_2-Y_1-Y_2-Y_3-Y_4-Z_1-Z_2-Z_3$, $X_1-X_2-X_3-Y_1-Y_2-Y_3-Y_4-Z_1-Z_2-Z_3$, $X_1-X_2-X_3-X_4-Y_1-Y_2-Y_3-Y_4-Z_1-Z_2-Z_3$, $Z_1-X_1-X_2-Y_1-Y_2-Z_1-Z_2-Z_3$, $Z_1-X_1-X_2-X_3-Y_1-Y_2-Z_1-Z_2-Z_3$, $Z_1-X_1-X_2-X_3-X_4-Y_1-Y_2-Z_1-Z_2-Z_3$, $Z_1-X_1-X_2-Y_1-Y_2-Y_3-Z_1-Z_2-Z_3$, $Z_1-X_1-X_2-X_3-Y_1-Y_2-Y_3-Z_1-Z_2-Z_3$, $Z_1-X_1-X_2-X_3-X_4-Y_1-Y_2-Y_3-Z_1-Z_2-Z_3$, $Z_1-X_1-X_2-Y_1-Y_2-Y_3-Y_4-Z_1-Z_2-Z_3$, $Z_1-X_1-X_2-X_3-Y_1-Y_2-Y_3-Y_4-Z_1-Z_2-Z_3$, $Z_1-X_1-X_2-X_3-X_4-Y_1-Y_2-Y_3-Y_4-Z_1-Z_2-Z_3$, $Z_1-Z_2-X_1-X_2-Y_1-Y_2-Z_1-Z_2-Z_3$, $Z_1-Z_2-X_1-X_2-X_3-Y_1-Y_2-Z_1-Z_2-Z_3$, $Z_1-Z_2-X_1-X_2-X_3-X_4-Y_1-Y_2-Z_1-Z_2-Z_3$, $Z_1-Z_2-X_1-X_2-Y_1-Y_2-Y_3-Z_1-Z_2-Z_3$, $Z_1-Z_2-X_1-X_2-X_3-Y_1-Y_2-Y_3-Z_1-Z_2-Z_3$, $Z_1-Z_2-X_1-X_2-X_3-X_4-Y_1-Y_2-Y_3-Z_1-Z_2-Z_3$, $Z_1-Z_2-X_1-X_2-Y_1-Y_2-Y_3-Y_4-Z_1-Z_2-Z_3$, $Z_1-Z_2-X_1-X_2-X_3-Y_1-Y_2-Y_3-Y_4-Z_1-Z_2-Z_3$, $Z_1-Z_2-X_1-X_2-X_3-X_4-Y_1-Y_2-Y_3-Y_4-Z_1-Z_2-Z_3$, $Z_1-Z_2-Z_3-X_1-X_2-Y_1-Y_2-Z_1-Z_2-Z_3$, $Z_1-Z_2-Z_3-X_1-X_2-X_3-Y_1-Y_2-Z_1-Z_2-Z_3$, $Z_1-Z_2-Z_3-X_1-X_2-X_3-X_4-Y_1-Y_2-Z_1-Z_2-Z_3$, $Z_1-Z_2-Z_3-X_1-X_2-Y_1-Y_2-Y_3-Z_1-Z_2-Z_3$, $Z_1-Z_2-Z_3-X_1-X_2-X_3-Y_1-Y_2-Y_3-Z_1-Z_2-Z_3$, $Z_1-Z_2-Z_3-X_1-X_2-X_3-X_4-Y_1-Y_2-Y_3-Z_1-Z_2-Z_3$, $Z_1-Z_2-Z_3-X_1-X_2-Y_1-Y_2-Y_3-Y_4-Z_1-Z_2-Z_3$, $Z_1-Z_2-Z_3-X_1-X_2-X_3-Y_1-Y_2-Y_3-Y_4-Z_1-Z_2-Z_3$, $Z_1-Z_2-Z_3-X_1-X_2-X_3-X_4-Y_1-Y_2-Y_3-Y_4-Z_1-Z_2-Z_3$, $Z_1-Z_2-Z_3-Z_4-X_1-X_2-Y_1-Y_2-Z_1-Z_2-Z_3$, $Z_1-Z_2-Z_3-Z_4-X_1-X_2-X_3-Y_1-Y_2-Z_1-Z_2-Z_3$, $Z_1-Z_2-Z_3-Z_4-X_1-X_2-X_3-X_4-Y_1-Y_2-Z_1-Z_2-Z_3$, $Z_1-Z_2-Z_3-Z_4-X_1-X_2-Y_1-Y_2-Y_3-Z_1-Z_2-Z_3$, $Z_1-Z_2-Z_3-Z_4-X_1-X_2-X_3-Y_1-Y_2-Y_3-Z_1-Z_2-Z_3$, $Z_1-Z_2-Z_3-Z_4-X_1-X_2-X_3-X_4-Y_1-Y_2-Y_3-Z_1-Z_2-Z_3$, $Z_1-Z_2-Z_3-Z_4-X_1-X_2-Y_1-Y_2-Y_3-Y_4-Z_1-Z_2-Z_3$, $Z_1-Z_2-Z_3-Z_4-X_1-X_2-X_3-Y_1-Y_2-Y_3-Y_4-Z_1-Z_2-Z_3$, $Z_1-Z_2-Z_3-Z_4-X_1-X_2-X_3-X_4-Y_1-Y_2-Y_3-Y_4-Z_1-Z_2-Z_3$, $X_1-X_2-Y_1-Y_2-Z_1-Z_2-Z_3-Z_4$, $X_1-X_2-X_3-Y_1-Y_2-Z_1-Z_2-Z_3-Z_4$, $X_1-X_2-X_3-X_4-Y_1-Y_2-Z_1-Z_2-Z_3-Z_4$, $X_1-X_2-Y_1-Y_2-Y_3-Z_1-Z_2-Z_3-Z_4$, $X_1-X_2-X_3-Y_1-Y_2-Y_3-Z_1-Z_2-Z_3-Z_4$, $X_1-X_2-X_3-X_4-Y_1-Y_2-Y_3-Z_1-Z_2-Z_3-Z_4$, $X_1-X_2-Y_1-Y_2-Y_3-Y_4-Z_1-Z_2-Z_3-Z_4$, $X_1-X_2-X_3-Y_1-Y_2-Y_3-Y_4-Z_1-Z_2-Z_3-Z_4$, $X_1-X_2-X_3-X_4-Y_1-Y_2-Y_3-Y_4-Z_1-Z_2-Z_3-Z_4$, $Z_1-X_1-X_2-Y_1-Y_2-Z_1-Z_2-Z_3-Z_4$, $Z_1-X_1-X_2-X_3-Y_1-Y_2-Z_1-Z_2-Z_3-Z_4$, $Z_1-X_1-X_2-X_3-X_4-Y_1-Y_2-Z_1-Z_2-Z_3-Z_4$, $Z_1-X_1-X_2-Y_1-Y_2-Y_3-Z_1-Z_2-Z_3-Z_4$, $Z_1-X_1-X_2-X_3-Y_1-Y_2-Y_3-Z_1-Z_2-Z_3-Z_4$, $Z_1-X_1-X_2-X_3-X_4-Y_1-Y_2-Y_3-Z_1-Z_2-Z_3-Z_4$, $Z_1-X_1-X_2-Y_1-Y_2-Y_3-Y_4-Z_1-Z_2-Z_3-Z_4$, $Z_1-X_1-X_2-X_3-Y_1-Y_2-Y_3-Y_4-Z_1-Z_2-Z_3-Z_4$, $Z_1-X_1-X_2-X_3-X_4-Y_1-Y_2-Y_3-Y_4-Z_1-Z_2-Z_3-Z_4$, $Z_1-Z_2-X_1-X_2-Y_1-Y_2-Z_1-Z_2-Z_3-Z_4$, $Z_1-Z_2-X_1-X_2-X_3-Y_1-Y_2-Z_1-Z_2-Z_3-Z_4$, $Z_1-Z_2-X_1-X_2-X_3-X_4-Y_1-Y_2-Z_1-Z_2-Z_3-Z_4$, $Z_1-Z_2-X_1-X_2-Y_1-Y_2-Y_3-Z_1-Z_2-Z_3-Z_4$, $Z_1-Z_2-X_1-X_2-X_3-Y_1-Y_2-Y_3-Z_1-Z_2-Z_3-Z_4$, $Z_1-Z_2-X_1-X_2-X_3-X_4-Y_1-Y_2-Y_3-Z_1-Z_2-Z_3-Z_4$, $Z_1-Z_2-X_1-X_2-Y_1-Y_2-Y_3-Y_4-Z_1-Z_2-Z_3-Z_4$, $Z_1-Z_2-X_1-X_2-X_3-Y_1-Y_2-Y_3-Y_4-Z_1-Z_2-Z_3-Z_4$, $Z_1-Z_2-X_1-X_2-X_3-X_4-Y_1-Y_2-Y_3-Y_4-Z_1-Z_2-Z_3-Z_4$, $Z_1-Z_2-Z_3-X_1-X_2-Y_1-Y_2-Z_1-Z_2-Z_3-Z_4$, $Z_1-Z_2-Z_3-X_1-X_2-X_3-Y_1-Y_2-Z_1-Z_2-Z_3-Z_4$, $Z_1-Z_2-Z_3-X_1-X_2-X_3-X_4-Y_1-Y_2-Z_1-Z_2-Z_3-Z_4$, $Z_1-Z_2-Z_3-X_1-X_2-Y_1-Y_2-Y_3-Z_1-Z_2-Z_3-Z_4$, $Z_1-Z_2-Z_3-X_1-X_2-X_3-Y_1-Y_2-Y_3-Z_1-Z_2-Z_3-Z_4$, $Z_1-Z_2-Z_3-X_1-X_2-X_3-X_4-Y_1-Y_2-Y_3-Z_1-Z_2-Z_3-Z_4$, $Z_1-Z_2-Z_3-X_1-X_2-Y_1-Y_2-Y_3-Y_4-Z_1-Z_2-Z_3-Z_4$, $Z_1-Z_2-Z_3-X_1-X_2-X_3-Y_1-Y_2-Y_3-Y_4-Z_1-Z_2-Z_3-Z_4$, $Z_1-Z_2-Z_3-X_1-X_2-X_3-X_4-Y_1-Y_2-Y_3-Y_4-Z_1-Z_2-Z_3-Z_4$, $Z_1-Z_2-Z_3-Z_4-X_1-X_2-Y_1-Y_2-Z_1-Z_2-Z_3-Z_4$, $Z_1-Z_2-Z_3-Z_4-X_1-X_2-X_3-Y_1-Y_2-Z_1-Z_2-Z_3-Z_4$, $Z_1-Z_2-Z_3-Z_4-X_1-X_2-X_3-X_4-Y_1-Y_2-Z_1-Z_2-Z_3-Z_4$, $Z_1-Z_2-Z_3-Z_4-X_1-X_2-Y_1-Y_2-Y_3-Z_1-Z_2-Z_3-Z_4$, $Z_1-Z_2-Z_3-Z_4-X_1-X_2-X_3-Y_1-Y_2-Y_3-Z_1-Z_2-Z_3-Z_4$, $Z_1-Z_2-Z_3-Z_4-X_1-X_2-X_3-X_4-Y_1-Y_2-Y_3-Z_1-Z_2-Z_3-Z_4$, $Z_1-Z_2-Z_3-Z_4-X_1-X_2-Y_1-Y_2-Y_3-Y_4-Z_1-Z_2-Z_3-Z_4$, $Z_1-Z_2-Z_3-Z_4-X_1-X_2-X_3-Y_1-Y_2-Y_3-Y_4-Z_1-Z_2-Z_3-Z_4$, $Z_1-Z_2-Z_3-Z_4-X_1-X_2-X_3-X_4-Y_1-Y_2-Y_3-Y_4-Z_1-Z_2-Z_3-Z_4$, $Z_1-Y_1-Y_2-X_1-X_2$, $Z_1-Y_1-Y_2-X_1-X_2-X_3$, $Z_1-Y_1-Y_2-X_1-X_2-X_3-X_4$, $Z_1-Y_1-Y_2-Y_3-X_1-X_2$, $Z_1-Y_1-Y_2-Y_3-X_1-X_2-X_3$, $Z_1-Y_1-Y_2-Y_3-X_1-X_2-X_3-X_4$, $Z_1-Y_1-Y_2-Y_3-Y_4-X_1-X_2$, $Z_1-Y_1-Y_2-Y_3-Y_4-X_1-X_2-X_3$, $Z_1-Y_1-Y_2-Y_3-Y_4-X_1-X_2-X_3-X_4$, $Z_1-Z_2-Y_1-Y_2-X_1-X_2$, $Z_1-Z_2-Y_1-Y_2-X_1-X_2-X_3$, $Z_1-Z_2-Y_1-Y_2-X_1-X_2-X_3-X_4$, $Z_1-Z_2-Y_1-Y_2-Y_3-X_1-X_2$, $Z_1-Z_2-Y_1-Y_2-Y_3-X_1-X_2-X_3$, $Z_1-Z_2-Y_1-Y_2-Y_3-X_1-X_2-X_3-X_4$, $Z_1-Z_2-Y_1-Y_2-Y_3-Y_4-X_1-X_2$, $Z_1-Z_2-Y_1-Y_2-Y_3-Y_4-X_1-X_2-X_3$, $Z_1-Z_2-Y_1-Y_2-Y_3-Y_4-X_1-X_2-X_3-X_4$, $Z_1-Z_2-Z_3-Y_1-Y_2-X_1-X_2$, $Z_1-Z_2-Z_3-Y_1-Y_2-X_1-X_2-X_3$, $Z_1-Z_2-Z_3-Y_1-Y_2-X_1-X_2-X_3-X_4$, $Z_1-Z_2-Z_3-Y_1-Y_2-Y_3-X_1-X_2$, $Z_1-Z_2-Z_3-Y_1-Y_2-Y_3-X_1-X_2-X_3$, $Z_1-Z_2-Z_3-Y_1-Y_2-Y_3-X_1-X_2-X_3-X_4$, $Z_1-Z_2-Z_3-Y_1-Y_2-Y_3-Y_4-X_1-X_2$, $Z_1-Z_2-Z_3-Y_1-Y_2-Y_3-Y_4-X_1-$ $X_2-X_3$, $Z_1-Z_2-Z_3-Y_1-Y_2-Y_3-Y_4-X_1-X_2-X_3-X_4$, $Z_1-Z_2-Z_3-Z_4-Y_1-Y_2-X_1-X_2$, $Z_1-Z_2-Z_3-Z_4-Y_1-Y_2-X_1-X_2-X_3$, $Z_1-Z_2-Z_3-Z_4-Y_1-Y_2-X_1-X_2-X_3-X_4$, $Z_1-Z_2-Z_3-Z_4-Y_1-Y_2-Y_3-X_1-X_2$, $Z_1-Z_2-Z_3-Z_4-Y_1-Y_2-Y_3-X_1-X_2-X_3$, $Z_1-Z_2-Z_3-Z_4-Y_1-Y_2-Y_3-X_1-X_2-X_3-X_4$, $Z_1-Z_2-Z_3-Z_4-Y_1-Y_2-Y_3-Y_4-X_1-X_2$, $Z_1-Z_2-Z_3-Z_4-Y_1-Y_2-Y_3-Y_4-X_1-X_2-X_3$, $Z_1-Z_2-Z_3-Z_4-Y_1-Y_2-Y_3-Y_4-X_1-X_2-X_3-X_4$, $Y_1-Y_2-X_1-X_2-Z_1$, $Y_1-Y_2-X_1-X_2-X_3-Z_1$, $Y_1-Y_2-X_1-X_2-X_3-X_4-Z_1$, $Y_1-Y_2-Y_3-X_1-X_2-Z_1$, $Y_1-Y_2-Y_3-X_1-X_2-X_3-Z_1$, $Y_1-Y_2-Y_3-X_1-X_2-X_3-X_4-Z_1$, $Y_1-Y_2-Y_3-Y_4-X_1-X_2-Z_1$, $Y_1-Y_2-Y_3-Y_4-X_1-X_2-X_3-Z_1$, $Y_1-Y_2-Y_3-Y_4-X_1-X_2-X_3-X_4-Z_1$, $Z_1-Y_1-Y_2-X_1-X_2-Z_1$, $Z_1-Y_1-Y_2-X_1-X_2-X_3-Z_1$, $Z_1-Y_1-Y_2-X_1-X_2-X_3-X_4-Z_1$, $Z_1-Y_1-Y_2-Y_3-X_1-X_2-Z_1$, $Z_1-Y_1-Y_2-Y_3-X_1-X_2-X_3-Z_1$, $Z_1-Y_1-Y_2-Y_3-X_1-X_2-X_3-X_4-Z_1$, $Z_1-Y_1-Y_2-Y_3-Y_4-X_1-X_2-Z_1$, $Z_1-Y_1-Y_2-Y_3-Y_4-X_1-X_2-X_3-Z_1$, $Z_1-Y_1-Y_2-Y_3-Y_4-X_1-X_2-X_3-X_4-Z_1$, $Z_1-Z_2-Y_1-Y_2-X_1-X_2-Z_1$, $Z_1-Z_2-Y_1-Y_2-X_1-X_2-X_3-Z_1$, $Z_1-Z_2-Y_1-Y_2-X_1-X_2-X_3-X_4-Z_1$, $Z_1-Z_2-Y_1-Y_2-Y_3-X_1-X_2-Z_1$, $Z_1-Z_2-Y_1-Y_2-Y_3-X_1-X_2-X_3-Z_1$, $Z_1-Z_2-Y_1-Y_2-Y_3-X_1-X_2-X_3-X_4-Z_1$, $Z_1-Z_2-Y_1-Y_2-Y_3-Y_4-X_1-X_2-Z_1$, $Z_1-Z_2-Y_1-Y_2-Y_3-Y_4-X_1-X_2-X_3-Z_1$, $Z_1-Z_2-Y_1-Y_2-Y_3-Y_4-X_1-X_2-X_3-X_4-Z_1$, $Z_1-Z_2-Z_3-Y_1-Y_2-X_1-X_2-Z_1$, $Z_1-Z_2-Z_3-Y_1-Y_2-X_1-X_2-X_3-Z_1$, $Z_1-Z_2-Z_3-Y_1-Y_2-X_1-X_2-X_3-X_4-Z_1$, $Z_1-Z_2-Z_3-Y_1-Y_2-Y_3-X_1-X_2-Z_1$, $Z_1-Z_2-Z_3-Y_1-Y_2-Y_3-X_1-X_2-X_3-Z_1$, $Z_1-Z_2-Z_3-Y_1-Y_2-Y_3-X_1-X_2-X_3-X_4-Z_1$, $Z_1-Z_2-Z_3-Y_1-Y_2-Y_3-Y_4-X_1-X_2-Z_1$, $Z_1-Z_2-Z_3-Y_1-Y_2-Y_3-Y_4-X_1-X_2-X_3-Z_1$, $Z_1-Z_2-Z_3-Y_1-Y_2-Y_3-Y_4-X_1-X_2-X_3-X_4-Z_1$, $Z_1-Z_2-Z_3-Z_4-Y_1-Y_2-X_1-X_2-Z_1$, $Z_1-Z_2-Z_3-Z_4-Y_1-Y_2-X_1-X_2-X_3-Z_1$, $Z_1-Z_2-Z_3-Z_4-Y_1-Y_2-X_1-X_2-X_3-X_4-Z_1$, $Z_1-Z_2-Z_3-Z_4-Y_1-Y_2-Y_3-X_1-X_2-Z_1$, $Z_1-Z_2-Z_3-Z_4-Y_1-Y_2-Y_3-X_1-X_2-X_3-Z_1$, $Z_1-Z_2-Z_3-Z_4-Y_1-Y_2-Y_3-X_1-X_2-X_3-X_4-Z_1$, $Z_1-Z_2-Z_3-Z_4-Y_1-Y_2-Y_3-Y_4-X_1-X_2-Z_1$, $Z_1-Z_2-Z_3-Z_4-Y_1-Y_2-Y_3-Y_4-X_1-X_2-X_3-Z_1$, $Z_1-Z_2-Z_3-Z_4-Y_1-Y_2-Y_3-Y_4-X_1-X_2-X_3-X_4-Z_1$, $Y_1-Y_2-X_1-X_2-Z_1-Z_2$, $Y_1-Y_2-X_1-X_2-X_3-Z_1-Z_2$, $Y_1-Y_2-X_1-X_2-X_3-X_4-Z_1-Z_2$, $Y_1-Y_2-Y_3-X_1-X_2-Z_1-Z_2$, $Y_1-Y_2-Y_3-X_1-X_2-X_3-Z_1-Z_2$, $Y_1-Y_2-Y_3-X_1-X_2-X_3-X_4-Z_1-Z_2$, $Y_1-Y_2-Y_3-Y_4-X_1-X_2-Z_1-Z_2$, $Y_1-Y_2-Y_3-Y_4-X_1-X_2-X_3-Z_1-Z_2$, $Y_1-Y_2-Y_3-Y_4-X_1-X_2-X_3-X_4-Z_1-Z_2$, $Z_1-Y_1-Y_2-X_1-X_2-Z_1-Z_2$, $Z_1-Y_1-Y_2-X_1-X_2-X_3-Z_1-Z_2$, $Z_1-Y_1-Y_2-X_1-X_2-X_3-X_4-Z_1-Z_2$, $Z_1-Y_1-Y_2-Y_3-X_1-X_2-Z_1-Z_2$, $Z_1-Y_1-Y_2-Y_3-X_1-X_2-X_3-Z_1-Z_2$, $Z_1-Y_1-Y_2-Y_3-X_1-X_2-X_3-X_4-Z_1-Z_2$, $Z_1-Y_1-Y_2-Y_3-Y_4-X_1-X_2-Z_1-Z_2$, $Z_1-Y_1-Y_2-Y_3-Y_4-X_1-X_2-X_3-Z_1-Z_2$, $Z_1-Y_1-Y_2-Y_3-Y_4-X_1-X_2-X_3-X_4-Z_1-Z_2$, $Z_1-Z_2-Y_1-Y_2-X_1-X_2-Z_1-Z_2$, $Z_1-Z_2-Y_1-Y_2-X_1-X_2-X_3-Z_1-Z_2$, $Z_1-Z_2-Y_1-Y_2-X_1-X_2-X_3-X_4-Z_1-Z_2$, $Z_1-Z_2-Y_1-Y_2-Y_3-X_1-X_2-Z_1-Z_2$, $Z_1-Z_2-Y_1-Y_2-Y_3-X_1-X_2-X_3-Z_1-Z_2$, $Z_1-Z_2-Y_1-Y_2-Y_3-X_1-X_2-X_3-X_4-Z_1-Z_2$, $Z_1-Z_2-Y_1-Y_2-Y_3-Y_4-X_1-X_2-Z_1-Z_2$, $Z_1-Z_2-Y_1-Y_2-Y_3-Y_4-X_1-X_2-X_3-Z_1-Z_2$, $Z_1-Z_2-Y_1-Y_2-Y_3-Y_4-X_1-X_2-X_3-X_4-Z_1-Z_2$, $Z_1-Z_2-Z_3-Y_1-Y_2-X_1-X_2-Z_1-Z_2$, $Z_1-Z_2-Z_3-Y_1-Y_2-X_1-X_2-X_3-Z_1-Z_2$, $Z_1-Z_2-Z_3-Y_1-Y_2-X_1-X_2-X_3-X_4-Z_1-Z_2$, $Z_1-Z_2-Z_3-Y_1-Y_2-Y_3-X_1-X_2-Z_1-Z_2$, $Z_1-Z_2-Z_3-Y_1-Y_2-Y_3-X_1-X_2-X_3-Z_1-Z_2$, $Z_1-Z_2-Z_3-Y_1-Y_2-Y_3-X_1-X_2-X_3-X_4-Z_1-Z_2$, $Z_1-Z_2-Z_3-Y_1-Y_2-Y_3-Y_4-X_1-X_2-Z_1-Z_2$, $Z_1-Z_2-Z_3-Y_1-Y_2-Y_3-Y_4-X_1-X_2-X_3-Z_1-Z_2$, $Z_1-Z_2-Z_3-Y_1-Y_2-Y_3-Y_4-X_1-X_2-X_3-X_4-Z_1-Z_2$, $Z_1-Z_2-Z_3-Z_4-Y_1-Y_2-X_1-X_2-Z_1-Z_2$, $Z_1-Z_2-Z_3-Z_4-Y_1-Y_2-X_1-X_2-X_3-Z_1-Z_2$, $Z_1-Z_2-Z_3-Z_4-Y_1-Y_2-X_1-X_2-X_3-X_4-Z_1-Z_2$, $Z_1-Z_2-Z_3-Z_4-Y_1-Y_2-Y_3-X_1-X_2-Z_1-Z_2$, $Z_1-Z_2-Z_3-Z_4-Y_1-Y_2-Y_3-X_1-X_2-X_3-Z_1-Z_2$, $Z_1-Z_2-Z_3-Z_4-Y_1-Y_2-Y_3-X_1-X_2-X_3-X_4-Z_1-Z_2$, $Z_1-Z_2-Z_3-Z_4-Y_1-Y_2-Y_3-Y_4-X_1-X_2-Z_1-Z_2$, $Z_1-Z_2-Z_3-Z_4-Y_1-Y_2-Y_3-Y_4-X_1-X_2-X_3-Z_1-Z_2$, $Z_1-Z_2-Z_3-Z_4-Y_1-Y_2-Y_3-Y_4-X_1-X_2-X_3-X_4-Z_1-Z_2$, $Y_1-Y_2-X_1-X_2-Z_1-Z_2-Z_3$, $Y_1-Y_2-X_1-X_2-X_3-Z_1-Z_2-Z_3$, $Y_1-Y_2-X_1-X_2-X_3-X_4-Z_1-Z_2-Z_3$, $Y_1-Y_2-Y_3-X_1-X_2-Z_1-Z_2-Z_3$, $Y_1-Y_2-Y_3-X_1-X_2-X_3-Z_1-Z_2-Z_3$, $Y_1-Y_2-Y_3-X_1-X_2-X_3-X_4-Z_1-Z_2-Z_3$, $Y_1-Y_2-Y_3-Y_4-X_1-X_2-Z_1-Z_2-Z_3$, $Y_1-Y_2-Y_3-Y_4-X_1-X_2-X_3-Z_1-Z_2-Z_3$, $Y_1-Y_2-Y_3-Y_4-X_1-X_2-X_3-X_4-Z_1-Z_2-Z_3$, $Z_1-Y_1-Y_2-X_1-X_2-Z_1-Z_2-Z_3$, $Z_1-Y_1-Y_2-X_1-X_2-X_3-Z_1-Z_2-Z_3$, $Z_1-Y_1-Y_2-X_1-X_2-X_3-X_4-Z_1-Z_2-Z_3$, $Z_1-Y_1-Y_2-Y_3-X_1-X_2-Z_1-Z_2-Z_3$, $Z_1-Y_1-Y_2-Y_3-X_1-X_2-X_3-Z_1-Z_2-Z_3$, $Z_1-Y_1-Y_2-Y_3-X_1-X_2-X_3-X_4-Z_1-Z_2-Z_3$, $Z_1-Y_1-Y_2-Y_3-Y_4-X_1-X_2-Z_1-Z_2-Z_3$, $Z_1-Y_1-Y_2-Y_3-Y_4-X_1-X_2-X_3-Z_1-Z_2-Z_3$, $Z_1-Y_1-Y_2-Y_3-Y_4-X_1-X_2-X_3-X_4-Z_1-Z_2-Z_3$, $Z_1-Z_2-Y_1-Y_2-X_1-X_2-Z_1-Z_2-Z_3$, $Z_1-Z_2-Y_1-Y_2-X_1-X_2-X_3-Z_1-Z_2-Z_3$, $Z_1-Z_2-Y_1-Y_2-X_1-X_2-X_3-X_4-Z_1-Z_2-Z_3$, $Z_1-Z_2-Y_1-Y_2-Y_3-X_1-X_2-Z_1-Z_2-Z_3$, $Z_1-Z_2-Y_1-Y_2-Y_3-X_1-X_2-X_3-Z_1-Z_2-Z_3$, $Z_1-Z_2-Y_1-Y_2-Y_3-X_1-X_2-X_3-X_4-Z_1-Z_2-Z_3$, $Z_1-Z_2-Y_1-Y_2-Y_3-Y_4-X_1-X_2-Z_1-Z_2-Z_3$, $Z_1-Z_2-Y_1-Y_2-Y_3-Y_4-X_1-X_2-X_3-Z_1-Z_2-Z_3$, $Z_1-Z_2-Y_1-Y_2-Y_3-Y_4-X_1-X_2-X_3-X_4-Z_1-Z_2-Z_3$, $Z_1-Z_2-Z_3-Y_1-Y_2-X_1-X_2-Z_1-Z_2-Z_3$, $Z_1-Z_2-Z_3-Y_1-Y_2-X_1-X_2-X_3-Z_1-Z_2-Z_3$, $Z_1-Z_2-Z_3-Y_1-Y_2-X_1-X_2-X_3-X_4-Z_1-Z_2-Z_3$, $Z_1-Z_2-Z_3-Y_1-Y_2-Y_3-X_1-X_2-Z_1-Z_2-Z_3$, $Z_1-Z_2-Z_3-Y_1-Y_2-Y_3-X_1-X_2-X_3-Z_1-Z_2-Z_3$, $Z_1-Z_2-Z_3-Y_1-Y_2-Y_3-X_1-X_2-X_3-X_4-Z_1-Z_2-Z_3$, $Z_1-Z_2-Z_3-Y_1-Y_2-Y_3-Y_4-X_1-X_2-Z_1-Z_2-Z_3$, $Z_1-Z_2-Z_3-Y_1-Y_2-Y_3-Y_4-X_1-X_2-X_3-Z_1-Z_2-Z_3$, $Z_1-Z_2-Z_3-Y_1-Y_2-Y_3-Y_4-X_1-X_2-X_3-X_4-Z_1-Z_2-Z_3$, $Z_1-Z_2-Z_3-Z_4-Y_1-Y_2-X_1-X_2-Z_1-Z_2-Z_3$, $Z_1-Z_2-Z_3-Z_4-Y_1-Y_2-X_1-X_2-X_3-Z_1-Z_2-Z_3$, $Z_1-Z_2-Z_3-Z_4-Y_1-Y_2-X_1-X_2-X_3-X_4-Z_1-Z_2-Z_3$, $Z_1-Z_2-Z_3-Z_4-Y_1-Y_2-Y_3-X_1-X_2-Z_1-Z_2-Z_3$, $Z_1-Z_2-Z_3-Z_4-Y_1-Y_2-Y_3-X_1-X_2-X_3-Z_1-Z_2-Z_3$, $Z_1-Z_2-Z_3-Z_4-Y_1-Y_2-Y_3-X_1-X_2-X_3-X_4-Z_1-Z_2-Z_3$, $Z_1-Z_2-Z_3-Z_4-Y_1-Y_2-Y_3-Y_4-X_1-X_2-Z_1-Z_2-Z_3$, $Z_1-Z_2-Z_3-Z_4-Y_1-Y_2-Y_3-Y_4-X_1-X_2-X_3-Z_1-Z_2-Z_3$, $Z_1-Z_2-Z_3-Z_4-Y_1-Y_2-Y_3-Y_4-X_1-X_2-X_3-X_4-Z_1-Z_2-Z_3$, $Y_1-Y_2-X_1-X_2-Z_1-Z_2-Z_3-Z_4$, $Y_1-Y_2-X_1-X_2-X_3-Z_1-Z_2-Z_3-Z_4$, $Y_1-Y_2-X_1-X_2-X_3-X_4-Z_1-Z_2-Z_3-Z_4$, $Y_1-Y_2-Y_3-X_1-X_2-Z_1-Z_2-Z_3-Z_4$, $Y_1-Y_2-Y_3-X_1-X_2-X_3-Z_1-Z_2-Z_3-Z_4$, $Y_1-Y_2-Y_3-X_1-X_2-X_3-X_4-Z_1-Z_2-Z_3-Z_4$, $Y_1-Y_2-Y_3-Y_4-X_1-X_2-Z_1-Z_2-Z_3-Z_4$, $Y_1-Y_2-Y_3-Y_4-X_1-X_2-X_3-Z_1-Z_2-Z_3-Z_4$, $Y_1-Y_2-Y_3-Y_4-X_1-X_2-X_3-X_4-Z_1-Z_2-Z_3-Z_4$, $Z_1-Y_1-Y_2-X_1-X_2-Z_1-Z_2-Z_3-Z_4$, $Z_1-Y_1-Y_2-X_1-X_2-X_3-Z_1-Z_2-Z_3-Z_4$, $Z_1-Y_1-Y_2-X_1-X_2-X_3-X_4-Z_1-Z_2-Z_3-Z_4$, $Z_1-Y_1-Y_2-Y_3-X_1-X_2-Z_1-Z_2-Z_3-Z_4$, $Z_1-Y_1-Y_2-Y_3-X_1-X_2-X_3-Z_1-Z_2-Z_3-Z_4$, $Z_1-Y_1-Y_2-Y_3-X_1-X_2-X_3-X_4-Z_1-Z_2-Z_3-Z_4$, $Z_1-Y_1-Y_2-Y_3-Y_4-X_1-X_2-Z_1-Z_2-Z_3-Z_4$, $Z_1-Y_1-Y_2-Y_3-Y_4-X_1-X_2-X_3-Z_1-Z_2-Z_3-Z_4$, $Z_1-Y_1-Y_2-Y_3-Y_4-X_1-X_2-X_3-X_4-Z_1-Z_2-Z_3-Z_4$, $Z_1-Z_2-Y_1-Y_2-X_1-X_2-Z_1-Z_2-Z_3-Z_4$, $Z_1-Z_2-Y_1-Y_2-X_1-X_2-X_3-Z_1-Z_2-Z_3-Z_4$, $Z_1-Z_2-Y_1-Y_2-X_1-X_2-X_3-X_4-Z_1-Z_2-Z_3-Z_4$, $Z_1-Z_2-Y_1-Y_2-Y_3-X_1-X_2-Z_1-Z_2-Z_3-Z_4$, $Z_1-Z_2-Y_1-Y_2-Y_3-X_1-X_2-X_3-Z_1-Z_2-Z_3-Z_4$, $Z_1-Z_2-Y_1-Y_2-Y_3-X_1-X_2-X_3-X_4-Z_1-Z_2-Z_3-Z_4$, $Z_1-Z_2-Y_1-Y_2-Y_3-Y_4-X_1-X_2-Z_1-Z_2-Z_3-Z_4$, $Z_1-Z_2-Y_1-Y_2-Y_3-Y_4-X_1-X_2-X_3-Z_1-Z_2-Z_3-Z_4$, $Z_1-Z_2-Y_1-Y_2-Y_3-Y_4-X_1-X_2-X_3-X_4-Z_1-Z_2-Z_3-Z_4$, $Z_1-Z_2-Z_3-Y_1-Y_2-X_1-X_2-Z_1-Z_2-Z_3-Z_4$, $Z_1-Z_2-Z_3-Y_1-Y_2-X_1-X_2-X_3-Z_1-Z_2-Z_3-Z_4$, $Z_1-Z_2-Z_3-Y_1-Y_2-X_1-X_2-X_3-X_4-Z_1-Z_2-Z_3-Z_4$, $Z_1-Z_2-Z_3-Y_1-Y_2-Y_3-X_1-X_2-Z_1-Z_2-Z_3-Z_4$, $Z_1-Z_2-Z_3-Y_1-Y_2-Y_3-X_1-X_2-X_3-Z_1-Z_2-Z_3-Z_4$, $Z_1-Z_2-Z_3-Y_1-Y_2-Y_3-X_1-X_2-X_3-X_4-Z_1-Z_2-Z_3-Z_4$, $Z_1-Z_2-Z_3-Y_1-Y_2-Y_3-Y_4-X_1-X_2-Z_1-Z_2-Z_3-Z_4$, $Z_1-Z_2-Z_3-Y_1-Y_2-Y_3-Y_4-X_1-X_2-X_3-Z_1-Z_2-Z_3-Z_4$, $Z_1-Z_2-Z_3-Y_1-Y_2-Y_3-Y_4-X_1-X_2-X_3-X_4-Z_1-Z_2-Z_3-Z_4$, $Z_1-Z_2-Z_3-Z_4-Y_1-Y_2-X_1-X_2-Z_1-Z_2-Z_3-Z_4$, $Z_1-Z_2-Z_3-Z_4-Y_1-Y_2-X_1-X_2-X_3-Z_1-Z_2-Z_3-Z_4$, $Z_1-Z_2-Z_3-Z_4-Y_1-Y_2-X_1-X_2-X_3-X_4-Z_1-Z_2-Z_3-Z_4$, $Z_1-Z_2-Z_3-Z_4-Y_1-Y_2-Y_3-X_1-X_2-Z_1-Z_2-Z_3-Z_4$, $Z_1-Z_2-Z_3-Z_4-Y_1-Y_2-Y_3-X_1-X_2-X_3-Z_1-Z_2-Z_3-Z_4$, $Z_1-Z_2-Z_3-Z_4-Y_1-Y_2-Y_3-X_1-X_2-X_3-X_4-Z_1-Z_2-Z_3-Z_4$, $Z_1-Z_2-Z_3-Z_4-Y_1-Y_2-Y_3-Y_4-X_1-X_2-Z_1-Z_2-Z_3-Z_4$, $Z_1-Z_2-Z_3-Z_4-Y_1-Y_2-Y_3-Y_4-X_1-X_2-X_3-Z_1-Z_2-Z_3-Z_4$, $Z_1-Z_2-Z_3-Z_4-Y_1-Y_2-Y_3-Y_4-X_1-X_2-X_3-X_4-Z_1-Z_2-Z_3-Z_4$, wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

In related embodiments, the method for controlling a pest infection provides expression and synthesis of an insecticidal and/or nematicidal protein in a plant or part thereof, for example, a plant tissue, a plant cell, and/or a plant seed. The insecticidal and/or nematicidal protein comprises a binary peptide as described above and can include a two amino acid spacer sequence (a Z region) fused in frame to the N-terminus and/or the C-terminus of an illustrative binary peptide disclosed above, wherein the two amino acid spacer sequence 422 sequence can be one or more of GS, WN, WQ, MA, and MV.

In some embodiments, the insecticidal and/or nematicidal protein for use in methods described above can comprise a cleavable tertiary peptide having one or more of the following illustrative amino acid sequences (ZXY or XYZ): AFVRLFGS (SEQ ID NO: 1649), AKLFVGS (SEQ ID NO: 1650), ALFALKGS (SEQ ID NO: 1651), ALFLKGS (SEQ ID NO: 1652), ALFLRGS (SEQ ID NO: 1653), ALFRGS (SEQ ID NO: 1654), ALFRLRGS (SEQ ID NO: 1655), ALKALFGS (SEQ ID NO: 1656), ALKFFGS (SEQ ID NO: 1657), ALKFLVGS (SEQ ID NO: 1658), ALKIFVGS (SEQ ID NO: 1659), ALKLFVGS (SEQ ID NO: 1660), FFADIKGS (SEQ ID NO: 1661), FFALKGS (SEQ ID NO: 1662), FFLKGS (SEQ ID NO: 1663), FFLRGS (SEQ ID NO: 1664), FFRLRGS (SEQ ID NO: 1665), FGYRIKGS (SEQ ID NO: 1666), FLRLFGS (SEQ ID NO: 1667), FYARRGS (SEQ ID NO: 1668), GGLRKKGS (SEQ ID NO: 1669), IFVALKGS (SEQ ID NO: 1670), IFVLKGS (SEQ ID NO: 1671), IFVLRGS (SEQ ID NO: 1672), IFVRGS (SEQ ID NO: 1673), IFVRLRGS (SEQ ID NO: 1674), ILFNIKGS (SEQ ID NO: 1675), LFAAPFGS (SEQ ID NO: 1676), LFVALKGS (SEQ ID NO: 1677), LFVLKGS (SEQ ID NO: 1678), LFVLRGS (SEQ ID NO: 1679), LFVRGS (SEQ ID NO: 1680), LFVRLRGS (SEQ ID NO: 1681), LFVRVFLGS (SEQ ID NO: 1682), LGERGS (SEQ ID NO: 1683), LKALFGS (SEQ ID NO: 1684), LKFFGS (SEQ ID NO: 1685), LKIFVGS (SEQ ID NO: 1686), LKLFVGS (SEQ ID NO: 1687), LRALFGS (SEQ ID NO: 1688), LRFFGS (SEQ ID NO: 1689), LRIFVGS (SEQ ID NO: 1690), LRLFVGS (SEQ ID NO: 1691), RALFGS (SEQ ID NO: 1692), RIFVGS (SEQ ID NO: 1693), RLFVGS (SEQ ID NO: 1694), RLRALFGS (SEQ ID NO: 1695), RLRFFGS (SEQ ID NO: 1696), RLRIFVGS (SEQ ID NO: 1697), RLRLFVGS (SEQ ID NO: 1698), RRKAFVGS (SEQ ID NO: 1699), RRKLIFGS (SEQ ID NO: 1700), RRRFFAGS (SEQ ID NO: 1701), VFGRKGGS (SEQ ID NO: 1702), YFVRKGS (SEQ ID NO: 1703), GSAFVRLF (SEQ ID NO: 1704), GSAKLFV (SEQ ID NO: 1705), GSALFALK (SEQ ID NO: 1706), GSALFLK (SEQ ID NO: 1707), GSALFLR (SEQ ID NO: 1708), GSALFR (SEQ ID NO: 1709), GSALFRLR (SEQ ID NO: 1710), GSALKALF (SEQ ID NO: 1711), GSALKFF (SEQ ID NO: 1712), GSALKFLV (SEQ ID NO: 1713), GSALKIFV (SEQ ID NO: 1714), GSALKLFV (SEQ ID NO: 1715), GSFFADIK (SEQ ID NO: 1716), GSFFALK (SEQ ID NO: 1717), GSFFLK (SEQ ID NO: 1718), GSFFLR (SEQ ID NO: 1719), GSFFRLR (SEQ ID NO: 1720), GSFGYRIK (SEQ ID NO: 1721), GSFLRLF (SEQ ID NO: 1722), GSFYARR (SEQ ID NO: 1723), GSGGLRKK (SEQ ID NO: 1724), GSIFVALK (SEQ ID NO: 1725), GSIFVLK (SEQ ID NO: 1726), GSIFVLR (SEQ ID NO: 1727), GSIFVR (SEQ ID NO: 1728), GSIFVRLR (SEQ ID NO: 1729), GSILFNIK (SEQ ID NO: 1730), GSLFAAPF (SEQ ID NO: 1731), GSLFVALK (SEQ ID NO: 1732), GSLFVLK (SEQ ID NO: 1733), GSLFVLR (SEQ ID NO: 1734), GSLFVR (SEQ ID NO: 1735), GSLFVRLR (SEQ ID NO: 1736), GSLFVRVFL (SEQ ID NO: 1737), GSLGER (SEQ ID NO: 1738), GSLKALF (SEQ ID NO: 1739), GSLKFF (SEQ ID NO: 1740), GSLKIFV (SEQ ID NO: 1741), GSLKLFV (SEQ ID NO: 1742), GSLRALF (SEQ ID NO: 1743), GSLRFF (SEQ ID NO: 1744), GSLRIFV (SEQ ID NO: 1745), GSLRLFV (SEQ ID NO: 1746), GSRALF (SEQ ID NO: 1747), GSRIFV (SEQ ID NO: 1748), GSRLFV (SEQ ID NO: 1749), GSRLRALF (SEQ ID NO: 1750), GSRLRFF (SEQ ID NO: 1751), GSRLRIFV (SEQ ID NO: 1752), GSRLRLFV (SEQ ID NO: 1753), GSRRKAFV (SEQ ID NO: 1754), GSRRKLIF (SEQ ID NO: 1755), GSRRRFFA (SEQ ID NO: 1756), GSVFGRKG (SEQ ID NO: 1757), and GSYFVRK (SEQ ID NO: 1758).

In various embodiments, the insecticidal and/or nematicidal protein for use in methods described above may be encoded by a polynucleotide that encodes a cleavable tertiary peptide having the amino acid sequence of a binary peptide as described above and herein, with the addition of a spacer to the N-terminus of the binary peptide, and/or to the C-terminus of the binary peptide, wherein the spacer is an amino acid or peptide comprising 1 to 4 amino acids, preferably two amino acids, for example GS, WN, WQ, MA, or MV. Other specific spacer examples and optimal amino acids for use as spacers are provided below. In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b (wherein the TPs, if more than one, may be the same or different), or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and each insecticidal and/or nematicidal protein further comprising one or more tertiary peptides (designated above as L), which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

Exemplary binary and tertiary peptides, for example, ALKLFV (SEQ ID NO: 1605), ALKFLV (SEQ ID NO: 1603) or IFVRLR (SEQ ID NO: 1619), fused to one or more TPs as described herein may be used to produce an insecticidal and/or nematicidal protein which when expressed and synthesized by a transgenic plant can fight a pest infection. In various embodiments, the method for controlling a pest infection of a plant includes planting a seed or a plant in a field, wherein the plant or seed is operable to express an insecticidal and/or nematicidal protein in the plant or the application of a composition containing an insecticidal and/or nematicidal protein comprising one or more TP proteins selected from the group consisting of a Pore Forming Insecticidal Protein (PFIP) and a Cysteine Rich Insecticidal Protein (CRIP), for example, the TP may be an Inhibitor Cysteine Knot (ICK) motif protein, a non-ICK protein, a Bt protein or any combination of these, and growing the plant or seed in the field which in the presence of the pest, is able to continue to survive and/or grow in the field in the presence of the pest. In such embodiments, the pest infection is reduced, by the death of at least a portion of the pests, after consuming the plant expressing the insecticidal and/or nematicidal protein or coated at least in part, with the insecticidal and/or nematicidal protein. In one embodiment, the TP useful in the method for controlling a pest infection can include an Inhibitor Cysteine Knot (ICK) motif protein derived from, or originates from, *Hadronyche versuta, Atrax robustus, Atrax formidabilis, Atrax infensus*, including TPs known as U-ACTX polypetides, U-ACTX-Hv1a, rU-ACTX-Hv1a, rU-ACTX-Hv1b, selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b, or a hybrid-ACTX-Hv1a peptide, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and mutants or variants thereof.

In some embodiments, the method of controlling a pest infection of a plant provides a pesticidally effective amount of one or more TPs synthesized by the plant or part thereof, in the form of an insecticidal and/or nematicidal protein. In some embodiments, an insecticidal and/or nematicidal protein comprising one or more TPs that are cleavable upon exposure to the gut environment of an insect and/or nematode can be produced from a DNA construct transformed into a plant or part thereof. In some embodiments, an exemplary DNA construct encodes one or more insecticidal and/or nematicidal proteins, each insecticidal and/or nematicidal protein comprises an ERSP fused in frame with the N-terminus of a binary or tertiary peptide, and the binary or tertiary peptide is fused in frame with a construct comprising $(TP-L)_n$ or $(L-TP)_n$, wherein each TP is toxic protein, L is a binary or tertiary peptide and n is an integer ranging from 1 to 200 and wherein the C-terminal TP is fused or unfused at its C-terminus with a binary or tertiary peptide. When n is greater than 1, each TP and each L may be the same or different.

In other embodiments, an exemplary method for controlling such a pest infection includes providing in a diet of the pest, a plant, or part thereof, wherein the plant or part thereof, contains and expresses a polynucleotide which encodes an insecticidal and/or nematicidal insecticidal and/or nematicidal protein comprising one or more TPs as described herein. In some embodiments, the plant expresses a polynucleotide constitutively, or inducibly. The polynucleotide may be operably linked to an operable promoter, for example, a homologous or heterologous promoter, wherein the polynucleotide encodes an insecticidal and/or nematicidal protein having one or more cleavable binary or tertiary peptides. The insecticidal and/or nematicidal protein can include the structure: (ERSP)-$(TP-L)_n$, or (ERSP)-(L)-$(TP-L)_n$, or (ERSP)-$(L-TP)_n$, or (ERSP)-$(L-TP)_n$-(L). In another embodiment, a plant, or part thereof comprises a polynucleotide operably linked to an operable promoter, for example, a homologous or heterologous promoter, wherein the polynucleotide encodes an insecticidal and/or nematicidal protein comprising an ERSP fused in frame with the N-terminus of a stabilizing domain (STA). The STA is fused in frame with either the N-terminus of a binary or tertiary peptide, or the N-terminus of a construct comprising: $(L-TP)_n$, $(L-TP)_n$-L, (TP-L)n, or L-$(TP-L)_n$. In various embodiments, an exemplary insecticidal and/or nematicidal protein can include a construct from N-terminus to C-terminus: (ERSP)-(L)-TP-(L)-TP, (ERSP)-(L)-TP-(L)-TP-(L), $(L-TP)_n$-L, (L-TP-L), (ERSP)-$(TP-L)_n$, (ERSP)-(L)-$(TP-L)_n$, (ERSP)-$(L-TP)_n$, (ERSP)-$(L-TP)_n$-(L), (ERSP)-(STA)$(L-TP)_n$, (ERSP)-(STA)-$(L-TP)_n$-(L), (ERSP)-(STA)-$(TP-L)_n$, or (ERSP)-(STA)-(L)-$(TP-L)_n$, or (STA)$(L-TP)_n$, or (STA)-$(L-TP)_n$-(L), or (STA)-$(TP-L)_n$, or (STA)-(L)-$(TP-L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different. The TPs useful in the transgenic plants or parts thereof disclosed herein, can have at least 50%, 55%, 60%, 65%, 70%, 75%, 80%, 85%, 90%, 95%, 96%, 97%, 98%, or 99% or greater sequence identity to SEQ ID NOs: 5 or 6, SEQ ID NO: 33 and/or a peptide selected from SEQ ID NOs: 33-1032 and variants thereof. In some embodiments, the C-terminal TP is fused or unfused at its C-terminus with a binary or tertiary peptide. In related embodiments of the above, TPs useful in the manufacture of a DNA construct or polynucleotide encoding: (1) an insecticidal and/or nematicidal protein, which may include one or more ICK TPs, for example, a TP selected from an "ACTX" or "ACTX peptide" family of insecticidal ICK peptides that have been isolated from an Australian funnel-web spiders belonging to the Atracinae subfamily, for example, one or more TPs selected from an Omega-ACTX TP, a Kappa-ACTX TP and an U-ACTX TP, for example, U+2-ACTX-Hv1a, U-ACTX-Hv1a, rU-ACTX-Hv1a, rU-ACTX-Hv1b, or a TP having at least 80%, at least 85%, at least 90%, at least 95%, at least 96%, at least 97%, at least 98%, at least 99%, or at least 100% sequence identity or sequence homology to a peptide or protein having an amino acid sequence as set forth in SEQ ID NOs: 5, 6 and 1761, 1762, 1767, 1771-1773, and variants thereof, (wherein the TPs, if more than one, may be the same or different) and wherein the DNA construct or polynucleotide further encodes (2) one or more tertiary peptides (designated above as L) fused in frame to at least one binary or tertiary peptide, which may include the amino acid sequence of a binary peptide selected from IFVRLR (SEQ ID NO: 1619), ALKLFV (SEQ ID NO: 1605), ALKFLV (SEQ ID NO: 1603), RRKAFV (SEQ ID NO: 1644), or LFAAPF (SEQ ID NO: 1621), fused in frame either on the N-terminus, C-terminus or both termini of the binary peptide with a Z region or spacer sequence selected from the group of or consisting of GS, WN, WQ, MA, MV, AM, LH, MN, ES, WQ, or DT.

In some embodiments, methods for controlling an insect and/or a nematode pest infection or infestation, may include the creation of a transgenic plant comprising a combination of insecticidal and/or nematicidal proteins, each insecticidal and/or nematicidal protein including a Bt (*Bacillus thuringiensis*) TP or an ICK (Inhibitor Cystine Knot) TP which when predated upon by said insect and/or nematode, will exert insecticidal and/or nematicidal activity and control or reduce or eliminate the pest infection and/or infestation. This plant can be made from independent stable genetic insertions of DNA that create a flowering plant expressing a Bt TP and a second flowering plant expressing a ICK TP. The pollen of one of those plants will be crossed onto the female flower organs of the other plant to form a genetic hybridization that contains both the Bt TP and the ICK TP genetic traits. The progeny of that sexual cross and further crossing that results in the inheritance of both traits will result in a transgenic plant comprising a combination of a Bt (*Bacillus thuringiensis*) TP and an ICK (Inhibitor Cystine Knot) TP to said insect and/or nematode.

In some embodiments, the DNA constructs described herein may encode insecticidal and/or nematicidal proteins that contain specific TPs that are suited to treat a specific pest infestation in a specific plant or groups of plants, for example, a particular type of crop. In one embodiment, insecticidal and/or nematicidal proteins of the present invention may comprise a TP selected from one or more of: Cry 1A.105, Cry2Ab2, Cry1F, Cry3Bbl, Cry34Ab1 and Cry35Ab1. These TPs may be expressed singly or in combinations to treat a specific crop, for example, corn. In some embodiments, insecticidal and/or nematicidal proteins having the structure from N-terminus to C-terminus: (ERSP)-(L)-TP-(L)-TP, (ERSP)-(L)-TP-(L)-TP-(L), $(L-TP)_n$-L, $(L-TP-L)_n$, (ERSP)-$(TP-L)_n$, (ERSP)-(L)-$(TP-L)_n$, (ERSP)-$(L-TP)_n$, (ERSP)-$(L-TP)_n$-(L), (ERSP)-(STA)-$(L-TP)_n$, (ERSP)-(STA)-$(L-TP)_n$-(L), (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different, wherein TP is toxic protein selected from Cry 1A.105, Cry2Ab2, Cry1F, Cry3Bbl, Cry34Ab1 and Cry35Ab1, or combinations thereof, and L is a binary or tertiary peptide and n is an integer ranging from 1 to 200, preferably an integer ranging from 1 to 100, and more preferably an integer ranging from 1 to 10 can be used to treat the following corn pests: European corn borer (ECB) Southwestern corn borer (SWCB)Southern cornstalk borer (SCSB), Corn earworm (CEW), Fall armyworm (FAW), Stalk borer, Lesser corn stalk borer, Sugarcane borer (SCB), Western bean cutworm (WBC), Black cutworm, Western corn rootworm (WCRW), Northern corn rootworm (NCRW), or Mexican corn rootworm. (MCRW).

In other embodiments, insecticidal and/or nematicidal proteins having the structure from N-terminus to C-terminus: (ERSP)-(L)-TP-(L)-TP, (ERSP)-(L)-TP-(L)-TP-(L), $(L-TP)_n$-L, $(L-TP-L)_n$, (ERSP)-$(TP-L)_n$, (ERSP)-(L)-$(TP-L)_n$, (ERSP)-$(L-TP)_n$, (ERSP)-$(L-TP)_n$-(L), (ERSP)-(STA)-$(L-TP)_n$, (ERSP)-(STA)-$(L-TP)_n$-(L), (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different, wherein TP is cotton Cry1AC, can be used to treat the following cotton PIP (Bollgard I and II—first one gene, then two genes) pests: cotton bollworm (CBW) *Helicoverpa zea* (Boddie), tobacco budworm (TBW) *Heliothis virescens*, and pink bollworm (PBW) *Pectinophora gossypiella* (Sanders). In a related embodiment, insecticidal and/or nematicidal proteins having the structure from N-terminus to C-terminus: (ERSP)-(L)-TP-(L)-TP, (ERSP)-(L)-TP-(L)-TP-(L), $(L-TP)_n$-L, $(L-TP-L)_n$, (ERSP)-$(TP-L)_n$, (ERSP)-(L)-$(TP-L)_n$, (ERSP)-$(L-TP)_n$, (ERSP)-$(L-TP)_n$-(L), (ERSP)-(STA)-$(L-TP)_n$, (ERSP)-(STA)-$(L-TP)_n$-(L), (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different, wherein TP is Cotton Cry1Ac and/or Cry2Ab, can be used to treat the following cotton pests: cotton bollworm (CBW) *Helicoverpa zea* (Boddie), tobacco budworm (TBW) *Heliothis virescens*, pink bollworm (PBW) *Pectinophora gossypiella* (Sanders), Fall armyworm (FAW), Beet armyworm (BAW), and Soybean looper (SBL).

In other embodiments, insecticidal and/or nematicidal proteins having the structure from N-terminus to C-terminus: (ERSP)-(L)-TP-(L)-TP, (ERSP)-(L)-TP-(L)-TP-(L), $(L-TP)_n$-L, $(L-TP-L)_n$, (ERSP)-$(TP-L)_n$, (ERSP)-(L)-$(TP-L)_n$, (ERSP)-$(L-TP)_n$, (ERSP)-$(L-TP)_n$-(L), (ERSP)-(STA)-$(L-TP)_n$, (ERSP)-(STA)-$(L-TP)_n$-(L), (ERSP)-(STA)-$(TP-L)_n$, or (ERSP)-(STA)-(L)-$(TP-L)_n$, or (STA)-$(L-TP)_n$, or (STA)-$(L-TP)_n$-(L), or (STA)-$(TP-L)_n$, or (STA)-(L)-$(TP-L)_n$, wherein (L) is a binary peptide or a tertiary peptide, and which each L may be the same or different, TP is a toxic peptide, which may be the same or different, and n is an integer ranging from 1 to 200, preferably 1 to 100, and most preferably, 1 to 10. In some embodiments, the insecticidal and/or nematicidal protein may contain TPs that are the same or different, and binary and/or tertiary peptides that are the same or different, wherein TP is Soybean Cry1Ac, can be used to treat the following soyabean PIP pests: velvetbean caterpillar (*Anticarcia gemmatalis*), soybean looper (*Pseudoplusia includens*), soybean anxil borer (*Epinotia aporema*), and sunflower looper (*Rachiplusia nu*).

In some embodiments, the method provides transforming a plant cell or a plurality of plant cells with a DNA construct which encodes insecticidal and/or nematicidal insecticidal and/or nematicidal protein containing compositions. The transformed plant may be a recombinant plant, a part of the plant, or a product of the plant or the plant part. While transformation of a plant or plant part may be pursued, the insecticidal and/or nematicidal compositions may be produced recombinantly in host cells including a bacterial host cell, a yeast host cell, a plant host cell or an animal host cell. In some embodiments, the insecticidal and/or nematicidal protein comprising an ERSP, one or more cleavable linking peptides and one or more TPs can be synthesized in a yeast production strain or in a bacterial production strain to produce milligram, gram or kilogram quantities of the insecticidal and/or nematicidal protein for application to a plurality of plants or a field of plants, i.e., crops to control or prevent a pest infection. In some embodiments, a pesticidally effective amount of the insecticidal and/or nematicidal protein can be provided in one or more formulations topically applied on the plant or a part of the plant, wherein the insecticidal and/or nematicidal protein is formulated in bacterial cells, bacterial spores, fungal cells, fungal spores, or parasporal crystals that comprise the insecticidal and/or nematicidal protein. Alternatively, the insecticidal and/or nematicidal compositions containing the insecticidal and/or nematicidal proteins can be applied directly to the surface of the plants.

As used herein, pesticidally effective amounts of the insecticidal and/or nematicidal proteins described herein includes any amount that may inhibit the growth, impair the movement, or even kill an insect and/or nematode when the TP cleaved from the insecticidal and/or nematicidal protein is appropriately delivered to the locus inhabited by the insect and/or nematode. In various embodiments, the insecticidal and/or nematicidal protein containing compositions can be formulated as powders, emulsions, solutions, granules, micronized particles, and the like and other formulations and forms of compositions used in the art for applying insecticidal proteins such as Bt proteins that can be applied to the surface of the plants for which pest control is desired. Amounts of TPs thus distributed assuming at least 50% cleavage and release of the TPs from the insecticidal and/or nematicidal protein can be quantified using C18 rpHPLC methods known by those skilled in the art.

In the embodiments described herein, the present insecticidal and/or nematicidal proteins comprising one or more TPs and one or more cleavable linkers are effective against a variety of insects and nematodes. The methods provided herein can be used to control, or prevent, or reduce the severity of a pest infection, to kill insects and/or nematodes which consume plants or parts thereof in their diets, to optimize the growth potential of a plant, to increase the yield of a crop susceptible to a pest infection, and various other methods requiring the control and/or elimination of insects and/or nematodes which predate on plant tissue. Various types of insects and nematodes susceptible to the methods, compositions and procedures described herein are as follows.

Insect and nematodes: Insects may be selected from the orders Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, and the like. More particularly, insect pests include Coleoptera, Lepidoptera, and Diptera.

Insects of suitable agricultural, household and/or medical/veterinary importance for treatment with the insecticidal polypeptides include, but are not limited to, members of the following classes and orders.

The order Coleoptera includes the suborders Adephaga and Polyphaga. Suborder Adephaga includes the superfamilies Caraboidea and Gyrinoidea. Suborder Polyphaga includes the superfamilies Hydrophiloidea, Staphylinoidea, Cantharoidea, Cleroidea, Elateroidea, Dascilloidea, Dryopoidea, Byrrhoidea, Cucujoidea, Meloidea, Mordelloidea, Tenebrionoidea, Bostrichoidea, Scarabaeoidea, Cerambycoidea, Chrysomeloidea, and Curculionoidea. Superfamily Caraboidea includes the families Cicindelidae, Carabidae, and Dytiscidae. Superfamily Gyrinoidea includes the family Gyrinidae. Superfamily Hydrophiloidea includes the family Hydrophilidae. Superfamily Staphylinoidea includes the families Silphidae and Staphylinidae. Superfamily Cantharoidea includes the families Cantharidae and Lampyridae. Superfamily Cleroidea includes the families Cleridae and Dermestidae. Superfamily Elateroidea includes the families Elateridae and Buprestidae. Superfamily Cucujoidea includes the family Coccinellidae. Superfamily Meloidea includes the family Meloidae. Superfamily Tenebrionoidea includes the family Tenebrionidae. Superfamily Scarabaeoidea includes the families Passalidae and Scarabaeidae. Superfamily Cerambycoidea includes the family Cerambycidae. Superfamily Chrysomeloidea includes the family Chrysomelidae. Superfamily Curculionoidea includes the families Curculionidae and Scolytidae.

Examples of Coleoptera include, but are not limited to: the American bean weevil *Acanthoscelides obtectus*, the leaf beetle *Agelastica alni*, click beetles (*Agriotes lineatus, Agriotes obscurus, Agriotes bicolor*), the grain beetle *Ahasverus advena*, the summer schafer *Amphimallon solstitialis*, the furniture beetle *Anobium punctatum, Anthonomus* spp. (weevils), the Pygmy mangold beetle *Atomaria linearis*, carpet beetles (*Anthrenus* spp., *Attagenus* spp.), the cowpea weevil *Callosobruchus maculates*, the fried fruit beetle *Carpophilus hemipterus*, the cabbage seedpod weevil *Ceutorhynchus assimilis*, the rape winter stem weevil *Ceutorhynchus picitarsis*, the wireworms *Conoderus vespertinus* and *Conoderus falli*, the banana weevil *Cosmopolites sordidus*, the New Zealand grass grub *Costelytra zealandica*, the June beetle *Cotinis nitida*, the sunflower stem weevil *Cylindrocopturus adspersus*, the larder beetle *Dermestes lardarius*, the corn rootworms *Diabrotica virgifera, Diabrotica virgifera virgifera*, and *Diabrotica barberi*, the Mexican bean beetle *Epilachna varivestis*, the old house borer *Hylotropes bajulus*, the lucerne weevil *Hypera postica*, the shiny spider beetle *Gibbium psylloides*, the cigarette beetle *Lasioderma serricorne*, the Colorado potato beetle *Leptinotarsa decemlineata, Lyctus* beetles' (*Lyctus* spp.), the pollen beetle *Meligethes aeneus*, the common cockshafer *Melolontha melolontha*, the American spider beetle *Mezium americanum*, the golden spider beetle *Niptus hololeucus*, the grain beetles *Oryzaephilus surinamensis* and *Oryzaephilus mercator*, the black vine weevil *Otiorhynchus sulcatus*, the mustard beetle *Phaedon cochleariae*, the crucifer flea beetle *Phyllotreta cruciferae*, the striped flea beetle *Phyllotreta striolata*, the cabbage steam flea beetle *Psylliodes chrysocephala, Ptinus* spp. (spider beetles), the lesser grain borer *Rhizopertha dominica*, the pea and been weevil *Sitona lineatus*, the rice and granary beetles *Sitophilus oryzae* and *Sitophilus granaries*, the red sunflower seed weevil *Smicronyx fulvus*, the drugstore beetle *Stegobiurn paniceum*, the yellow mealworm beetle *Tenebrio molitor*, the flour beetles *Tribolium castaneum* and *Tribolium confusum*, warehouse and cabinet beetles (*Trogoderma* spp.), and the sunflower beetle *Zygogramma exclamation's*.

Examples of Dermaptera (earwigs) include, but are not limited to: the European earwig *Forficula auricularia*, and the striped earwig *Labidura riparia*.

Examples of Dictvontera include, but are not limited to: the oriental cockroach *Blatta orientalis*, the German cockroach *Blatella germanica*, the Madeira cockroach *Leucophaea maderae*, the American cockroach *Periplaneta americana*, and the smokybrown cockroach *Periplaneta fuliginosa*.

Examples of Diplonoda include, but are not limited to: the spotted snake millipede *Blaniulus guttulatus*, the flat-back millipede *Brachydesmus superus*, and the greenhouse millipede *Oxidus gracilis*.

The order Diptera includes the Suborders Nematocera, Brachycera, and Cyclorrhapha. Suborder Nematocera includes the families Tipulidae, Psychodidae, Culicidae, Ceratopogonidae, Chironomidae, Simuliidae, Bibionidae, and Cecidomyiidae. Suborder Brachycera includes the families Stratiomyidae, Tabanidae, Therevidae, Asilidae, Mydidae, Bombyliidae, and Dolichopodidae. Suborder Cyclorrhapha includes the Divisions Aschiza and Aschiza. Division Aschiza includes the families Phoridae, Syrphidae, and Conopidae. Division Aschiza includes the Sections Acalyptratae and Calyptratae. Section Acalyptratae includes the families Otitidae, Tephritidae, Agromyzidae, and Drosophilidae. Section Calyptratae includes the families Hippoboscidae, Oestridae, Tachinidae, Anthomyiidae, Muscidae, Calliphoridae, and Sarcophagidae.

Examples of Diptera include, but are not limited to: the house fly (*Musca domestica*), the African tumbu fly (*Cordy-*

*lobia anthropophaga*), biting midges (*Culicoides* spp.), bee louse (*Braula* spp.), the beet fly *Pegomyia betae*, black flies (*Cnephia* spp., *Eusimulium* spp., *Simulium* spp.), bot flies (*Cuterebra* spp., *Gastrophilus* spp., *Oestrus* spp.), craneflies (*Tipula* spp.), eye gnats (*Hippelates* spp.), filth-breeding flies (*Calliphora* spp., *Fannia* spp., Hermetia spp., *Lucilia* spp., *Musca* spp., *Muscina* spp., *Phaenicia* spp., *Phormia* spp.), flesh flies (*Sarcophaga* spp., *Wohlfahrtia* spp.); the flit fly *Oscinella frit*, fruitflies (*Dacus* spp., *Drosophila* spp.), head and canon flies (*Hydrotea* spp.), the hessian fly *Mayetiola destructor*, horn and buffalo flies (*Haematobia* spp.), horse and deer flies (*Chrysops* spp., *Haematopota* spp., *Tabanus* spp.), louse flies (*Lipoptena* spp., *Lynchia* spp., and *Pseudolynchia* spp.), medflies (*Ceratitus* spp.), mosquitoes (*Aedes* spp., *Anopheles* spp., *Culex* spp., *Psorophora* spp.), sandflies (*Phlebotomus* spp., *Lutzomyia* spp.), screw-worm flies (*Chtysomya bezziana* and *Cochliomyia hominivorax*), sheep keds (*Melophagus* spp.); stable flies (*Stomoxys* spp.), tsetse flies (*Glossina* spp.), and warble flies (*Hypoderma* spp.).

Examples of Isontera (termites) include, but are not limited to: species from the familes Hodotennitidae, Kalotermitidae, Mastotermitidae, Rhinotennitidae, Serritermitidae, Termitidae, Termopsidae.

Examples of Heteroptera include, but are not limited to: the bed bug *Cimex lectularius*, the cotton stainer *Dysdercus intermedius*, the Sunn pest *Eurygaster integriceps*, the tarnished plant bug *Lygus lineolaris*, the green stink bug *Nezara antennata*, the southern green stink bug *Nezara viridula*, and the triatomid bugs *Panstrogylus megistus, Rhodnius ecuadoriensis, Rhodnius pallescans, Rhodnius prolixus, Rhodnius robustus, Triatoma dimidiata, Triatoma infestans*, and *Triatoma sordida.*

Examples of Homoptera include, but are not limited to: the California red scale *Aonidiella aurantii*, the black bean aphid *Aphis fabae*, the cotton or melon aphid *Aphis gossypii*, the green apple aphid *Aphis pomi*, the citrus spiny whitefly *Aleurocanthus spiniferus*, the *oleander* scale *Aspidiotus hederae*, the sweet potato whitefly *Bemesia tabaci*, the cabbage aphid *Brevicoryne brassicae*, the pear *psylla Cacopsylla pyricola*, the currant aphid *Cryptomyzus ribis*, the grape *phylloxera Daktulosphaira vitifoliae*, the citrus *psylla Diaphorina citri*, the potato leafhopper *Empoasca fabae*, the bean leafhopper *Empoasca solana*, the vine leafhopper *Empoasca vitis*, the woolly aphid *Eriosoma lanigerum*, the European fruit scale *Eulecanium corni*, the mealy plum aphid *Hyalopterus arundinis*, the small brown planthopper *Laodelphax striatellus*, the potato aphid *Macrosiphum euphorbiae*, the green peach aphid *Myzus persicae*, the green rice leafhopper *Nephotettix cinticeps*, the brown planthopper *Nilaparvata lugens*, gall-forming aphids (Pemphigus spp.), the hop aphid *Phorodon humuli*, the bird-cherry aphid *Rhopalosiphum padi*, the black scale *Saissetia oleae*, the greenbug *Schizaphis graminum*, the grain aphid *Sitobion avenae*, and the greenhouse whitefly *Trialeurodes vaporariorum.*

Examples of Isopoda include, but are not limited to: the common pillbug *Armadillidium vulgare* and the common woodlouse *Oniscus asellus.*

The order Lepidoptera includes the families Papilionidae, Pieridae, Lycaenidae, Nymphalidae, Danaidae, Satyridae, Hesperiidae, Sphingidae, Saturniidae, Geometridae, Arctiidae, Noctuidae, Lymantriidae, Sesiidae, and Tineidae.

Examples of Lepidoptera include, but are not limited to: *Adoxophyes orana* (summer fruit *tortrix* moth), *Agrotis ipsolon* (black cutworm), *Archips podana* (fruit tree *tortrix* moth), *Bucculatrix pyrivorella* (pear leafminer), *Bucculatrix thurberiella* (cotton leaf perforator), *Bupalus piniarius* (pine looper), *Carpocapsa pomonella* (codling moth), *Chilo suppressalis* (striped rice borer), *Choristoneura fumiferana* (eastern spruce budworm), *Cochylis hospes* (banded sunflower moth), *Diatraea grandiosella* (southwestern corn borer), Earls *insulana* (Egyptian bollworm), *Euphestia kuehniella* (Mediterranean flour moth), *Eupoecilia ambiguella* (European grape berry moth), *Euproctis chrysorrhoea* (brown-tail moth), *Euproctis subflava* (oriental tussock moth), *Galleria mellonella* (greater wax moth), *Helicoverpa armigera* (cotton bollworm), *Helicoverpa zea* (cotton bollworm), *Heliothis virescens* (tobacco budworm), *Hofmannophila pseudopretella* (brown house moth), *Homeosoma electellum* (sunflower moth), *Homona magnanima* (oriental tea tree *tortrix* moth), *Lithocolletis blancardella* (spotted tentiform leafminer), *Lymantria dispar* (gypsy moth), *Malacosoma neustria* (tent caterpillar), *Mamestra brassicae* (cabbage armyworm), *Mamestra configurata* (Bertha armyworm), the hornworms *Manduca sexta* and *Manuduca quinquemaculata, Operophtera brumata* (winter moth), *Ostrinia nubilalis* (European corn borer), *Panolis flammea* (pine beauty moth), *Pectinophora gossypiella* (pink bollworm), *Phyllocnistis citrella* (citrus leafminer), *Pieris brassicae* (cabbage white butterfly), *Plutella xylostella* (diamondback moth), *Rachiplusia ni* (soybean looper), *Spilosoma virginica* (yellow bear moth), *Spodoptera exigua* (beet armyworm), *Spodoptera frugiperda* (fall armyworm), *Spodoptera littoralis* (cotton leafworin), *Spodoptera litura* (common cutworm), *Spodoptera praefica* (yellowstriped armyworm), *Sylepta derogata* (cotton leaf roller), *Tineola bisselliella* (webbing clothes moth), *Tineola pellionella* (case-making clothes moth), *Tortrix viridana* (European oak leafroller), *Trichoplusia ni* (cabbage looper), and *Yponomeuta padella* (small ermine moth).

Examples of Orthoptera include, but are not limited to: the common cricket *Acheta domesticus*, tree locusts (*Anacridium* spp.), the migratory locust *Locusta migratoria*, the twostriped grasshopper *Melanoplus bivittatus*, the differential grasshopper *Melanoplus dfferentialis*, the redlegged grasshopper *Melanoplus femurrubrum*, the migratory grasshopper *Melanoplus sanguinipes*, the northern mole cricket *Neocurtilla hexadectyla*, the red locust *Nomadacris septemfasciata*, the shortwinged mole cricket *Scapteriscus abbreviatus*, the southern mole cricket *Scapteriscus borellii*, the tawny mole cricket *Scapteriscus vicinus*, and the desert locust *Schistocerca gregaria.*

Examples of Phthiraptera include, but are not limited to: the cattle biting louse *Bovicola bovis*, biting lice (*Damalinia* spp.), the cat louse *Felicola subrostrata*, the shortnosed cattle louse *Haematopinus eloysternus*, the tail-switch louse *Haematopinus quadriperiussus*, the hog louse *Haematopinus suis*, the face louse *Linognathus ovillus*, the foot louse *Linognathus pedalis*, the dog sucking louse *Linognathus setosus*, the long-nosed cattle louse *Linognathus vituli*, the chicken body louse *Menacanthus stramineus*, the poultry shaft louse *Menopon gallinae*, the human body louse *Pediculus humanus*, the pubic louse Phthirus pubis, the little blue cattle louse *Solenopotes capillatus*, and the dog biting louse *Trichodectes canis.*

Examples of Psocoptera include, but are not limited to: the booklice *Liposcelis bostrychophila, Liposcelis decolor, Liposcelis entomophila*, and *Trogium pulsatorium.*

Examples of Siphonaptera include, but are not limited to: the bird flea *Ceratophyllus gallinae*, the dog flea *Ctenocephalides canis*, the cat flea *Ctenocephalides* fells, the human flea *Pulex irritans*, and the oriental rat flea *Xenopsylla cheopis.*

Examples of Symphyla include, but are not limited to: the garden symphylan *Scutigerella immaculate.*

Examples of Thysanura include, but are not limited to: the gray silverfish *Ctenolepisma longicaudata*, the four-lined silverfish *Ctenolepisma quadriseriata*, the common silverfish *Lepisma saccharina*, and the firebrat *Thennobia domestica.*

Examples of Thysanoptera include, but are not limited to: the tobacco *thrips Frankliniella fusca*, the flower *thrips Frankliniella intonsa*, the western flower *thrips Frankliniella occidentalis*, the cotton bud *thrips Frankliniella schultzei*, the banded greenhouse *thrips Hercinothrips femoralis*, the soybean *thrips Neohydatothrips variabilis*, Kelly's citrus *thrips Pezothrips kellyanus*, the avocado *thrips Scirtothrips perseae*, the melon *thrips Thrips palmi*, and the onion *thrips Thrips tabaci.*

Examples of Nematodes include, but are not limited to: parasitic nematodes such as root-knot, cyst, and lesion nematodes, including *Heterodera* spp., *Meloidogyne* spp., and *Globodera* spp.; particularly members of the cyst nematodes, including, but not limited to: *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include, but are not limited to: *Pratylenchus* spp.

In one embodiment, the insecticidal and nematicidal compositions comprising the polypeptides, polynucleotides, cells, vectors, etc. described herein, can be employed to treat ectoparasites. Ectoparasites include, but are not limited to: fleas, ticks, mange, mites, mosquitoes, nuisance and biting flies, lice, and combinations comprising one or more of the foregoing ectoparasites. The term "fleas" includes the usual or accidental species of parasitic flea of the order Siphonaptera, and in particular the species *Ctenocephalides*, in particular *C. fells* and *C. cams*, rat fleas (*Xenopsylla cheopis*) and human fleas (*Pulex irritans*).

Insect pests of the invention for the major crops include, but are not limited to: Maize: *Ostrinia nubilalis*, European corn borer; *Agrotis ipsilon*, black cutworm; *Helicoverpa zea*, corn earworm; *Spodoptera frugiperda*, fall armyworm; *Diatraea grandiosella*, southwestern corn borer; *Elasmopalpus lignosellus*, lesser cornstalk borer; *Diatraea saccharalis, surgarcane borer; Diabrotica virgifera*, western corn rootworm; *Diabrotica longicornis barberi*, northern corn rootworm; *Diabrotica undecimpunctata howardi*, southern corn rootworm; *Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blot leafminer; *Anaphothrips obscrurus*, grass *thrips; Solenopsis milesta*, thief ant; *Tetranychus urticae*, twospotted spider mite; Sorghum: *Chilo partellus*, sorghum borer; *Spodoptera frugiperda*, fall armyworm; *Helicoverpa zea*, corn earworm; *Elasmopalpus lignosellus*, lesser cornstalk borer; *Feltia subterranea*, granulate cutworm; *Phyllophaga crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*, corn leaf aphid; *Sipha flava*, yellow sugarcane aphid; *Blissus leucopterus leucopterus*, chinch bug; *Contarinia sorghicola*, sorghum midge; *Tetranychus cinnabarinus*, carmine spider mite; *Tetranychus urticae*, twospotted spider mite; Wheat: *Pseudaletia unipunctata*, army worm; *Spodoptera frugiperda*, fall armyworm; *Elasmopalpus lignosellus*, lesser cornstalk borer; *Agrotis orthogonia*, western cutworm; *Elasmopalpus lignosellus*, lesser cornstalk borer; *Oulema melanopus*, cereal leaf beetle; *Hypera punctata*, clover leaf weevil; *Diabrotica undecimpunctata howardi*, southern corn rootworm; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarctata*, wheat bulb fly; *Frankliniella fusca*, tobacco *thrips; Cephus cinctus*, wheat stem sawfly; *Aceria tulipae*, wheat curl mite; Sunflower: *Suleima helianthana*, sunflower bud moth; *Homoeosoma electellum*, sunflower moth; *Zygogramma exclamationis*, sunflower beetle; *Bothyrus gibbosus*, carrot beetle; *Neolasioptera murtfeldtiana*, sunflower seed midge; Cotton: *Heliothis virescens*, cotton budworm; *Helicoverpa zea*, cotton bollworm; *Spodoptera exigua*, beet armyworm; *Pectinophora gossypiella*, pink bollworm; *Anthonomus grandis*, boll weevil; *Aphis gossypii*, cotton aphid; *Pseudatomoscelis seriatus*, cotton fleahopper; *Trialeurodes* abutilonea, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion *thrips; Franklinkiella fusca*, tobacco *thrips; Tetranychus cinnabarinus*, carmine spider mite; *Tetranychus urticae*, twospotted spider mite; Rice: *Diatraea saccharalis*, sugarcane borer; *Spodoptera frugiperda*, fall armyworm; *Helicoverpa zea*, corn earworm; *Colaspis brunnea*, grape *colaspis; Lissorhoptrus oryzophilus*, rice water weevil; *Sitophilus oryzae*, rice weevil; *Nephotettix nigropictus*, rice leafhopper; *Blissus leucopterus leucopterus*, chinch bug; *Acrosternum hilare*, green stink bug; Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, cotton budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean *thrips; Thrips tabaci*, onion *thrips; Tetranychus* turkestani, strawberry spider mite; *Tetranychus urticae*, twospotted spider mite; Barley: *Ostrinia nubilalis*, European corn borer; *Agrotis ipsilon*, black cutworm; *Schizaphis graminum*, greenbug; *Blissus leucopterus leucopterus*, chinch bug; *Acrosternum hilare*, green stink bug; *Euschistus servus*, brown stink bug; *Delia platura*, seedcorn maggot; *Mayetiola destructor*, Hessian fly; *Petrobia latens*, brown wheat mite; Oil Seed Rape: *Brevicoryne brassicae*, cabbage aphid; *Phyllotreta cruciferae*, Flea beetle; *Mamestra configurata*, Bertha armyworm; *Plutella xylostella*, Diamond-back moth; *Delia* ssp., Root maggots.

In some embodiments, the insecticidal compositions can be employed to treat combinations comprising one or more of the foregoing insects.

The insects that are susceptible to the peptides of this invention include but are not limited to the following: Blattaria, Coleoptera, Collembola, Diptera, Echinostomida, Hemiptera, Hymenoptera, Isoptera, Lepidoptera, Neuroptera, Orthoptera, Rhabditida, Siphonoptera, Thysanoptera. Genus-Species are indicated as follows: *Actebia-fennica, Agrotis-ipsilon, A.-segetum, Anticarsia-gemmatalis, Argyrotaenia-citrana, Artogeia-rapae, Bombyx mori, Busseola-fusca, Cacyreus-marshall, Chilo-suppressalis, Christoneura-fumiferana, C.-occidentalis, C. pinus pinus, C.-rosacena, Cnaphalocrocis-medinalis, Conopomorpha-cramerella, Ctenopsuestis-obliquana, Cydia-pomonella, Danaus-plexippus, Diabrotica undecimpunctata howardi, Diatraea-saccharallis, D.-grandiosella, Earias-vittella, Elasmolpalpus-lignoselius, Eldana-saccharina, Ephestia-kuehniella, Epinotia-aporema, Epiphyas-postvittana, Galleria-mellonella, Helicoverpa-zea, H-punctigera, H-armigera, Heliothis-virescens, Hyphantria-cunea, Lambdina-fiscellaria, Leguminivora-glycinivorella, Lobesia-botrana, Lymantria-dispar, Malacosoma-disstria, Mamestra-brassicae, M configurata, Manduca-sexta, Marasmia-patnalis, Maruca-vitrata, Orgyia-leucostigma, Ostrinia-nubilalis, O.-furnacalis, Pandemis-pyrusana, Pectinophora-gossypiella, Perileucoptera-coffeella, Phthorimaea-operculela, Pianotortrix-octo, Piatynota-stultana, Pieris-brassicae, Plodia-interpunctala, Plutella-xylostella, Pseudoplusia-includens, Rachiplusia-nu, Sciropophaga-incertulas, Sesamia-calamistis, Spilosoma-virginica, Spodoptera-exigua, S.-frugiperda, S.-littoralis, S.-exempta, S.-litura, Tecia-solanivora, Thaumetopoea-pityocampa, Trichoplusia-ni, Wiseana-cervinata, Wiseana-copularis, Wiseana-jocosa, Blattaria-Blattella, Collembola-Xenylla, C.-Folsomia, Echinostomida-Fasciola, Hemiptera-Oncopeltrus, He.-Bemisia, He.-Macrosiphum, He.-Rhopalosiphum, He.-Myzus, Hymenoptera-Diprion, Hy.-Apis, Hy.-Macrocentrus, Hy.-Meteorus, Hy.-Nasonia, Hy.-Solenopsis, Isopoda-Porcellio, Isoptera-Reticulitermes, Orthoptera-Achta, Prostigmata-Tetranychus, Rhabitida-Acrobeloides, R.-Caenorhabditis, R.-Distolabrellus, R.-Panagrellus, R.-Pristionchus, R.-Pratylenchus, R. Ancylostoma, R.-Nippostrongylus, R.-Panagrellus, R.-Haemonchus, R.-Meloidogyne, and Siphonaptera-Ctenocephalides*. As used herein, insect pests and nematode pests are those species of insects and nematodes that are susceptible to the insecticidal and/or nematicidal transgenic protein compositions and polypeptides that encode them.

Select list of highly susceptible insects and nematodes. The list below contains both insects and nematodes. Nematodes are also susceptible to the compositions and treatments identified in the application and claims. The insects and nematodes below are considered especially suitable and susceptible to the compositions and treatments identified in the specification and claims.

Stalk borer—*Busseola fusca*, Southern Cornstalk Borer—*Diatraea crambidoides*, True armyworm—*Pseudaletia unipuncta*, Western bean cutworm—*Striacosta albicosta*, Black cutworm—*Agrotis Ipsilon*, Corn earworm—*Helicoverpa zea*, European corn borer—*Ostrinia nubilalis*, Fall armyworm—*Spodoptera frugiperda*, Western corn rootworm—*Diabrotica virgifera virgifera*, Southern Corn Rootworm—*Diabrotica undecimpunctata howardi*, Northern Corn Rootworm—*Diabrotica barberi*, Western tarnished plant bug—*Lygus Hesperus*, Tarnished plant bug—*Lygus lineolaris*, Soybean cyst nematode—*Heterodera glycines*, Root—Knot Nematode—*Meloidogyne hapla*, Lesion nematode—*Pratylenchus penetrans*, Pink bollworm—*Pectinophora gossypiella*, Cotton bollworm—*Helicoverpa armigera*, Corn earworm—*Helicoverpa zea*, Sugarcane stalk borer—*Diatraea saccharalis*, Asian corn borer—*Ostrinia furnacalis*, Native budworm—*Helicoverpa punctigera*, Tobacco budworm—*Heliothis virescens*, Beet armyworm—*Spodoptera exigua*, Soybean Looper—*Chrysodeixis includens*, Velvetbean caterpillar—*Anticarcia gemmatalis*, Soybean looper—*Pseudoplusia* includes, Soybean anxil borer—*Epinotia aporema*, and Sunflower looper—*Rachiplusia nu.*

EXAMPLES

Example 1. Identification and Isolation of Binary and Tertiary Cleavable Linking Peptides 1.) the FRET Research and Discovery of Cleavable Linking Peptides To find a Linker with insect and/or nematode protease and human gastrointestinal cleavable properties, the inventors used a peptide library coupled to FRET molecules (a dye and a quencher) for the identification of peptides that cleave in either insect gut environment or in simulated human gastrointestinal environment as reporter assays. As shown in FIG. 1, a FRET kit contains pools of FRET molecules with a stretch of 3 variable amino acid sequences (grid pattern circle) bracketed by a series of glycine amino acids (horizontal line pattern) attached to either a dye (solid black circle with a protruding square) or a quencher (solid black circle with a square-shaped indent). FIG. 1 illustrates that each FRET molecule gives no signal if the variable region is not cleaved but can be excited if it is cleaved. The speed at which the cleavage occurs (i.e. the specificity of the sequence for the proteases) can be ranked by the rate at which the fluorescent signal occurs over time, i.e., its slope.

The FRET kit used (Cat. No. PSREPLI005, Mimotopes, Victoria, Australia) contains 512 pools of up to 8 different FRET molecules per pool. The FRET reaction is very high-throughput, with the enzymes added to the plate of pooled material with a multichannel loading pipet and then the plate is read once a minute for detectable fluorescence. The output of fluorescence detection is recorded for each reaction.

FRET samples were prepared immediately prior to assay as recommended by the manufacturer (add 5 μL, 50% acetonitrile in water to each well and agitate plate on shaker for 5 minutes. Then add 45 μL of assay buffer and agitate again for 5 minutes). At this point, the FRET pools were ready of the addition of 50 μL of the working enzyme stock to start the reactions. Using a multichannel, repeat pipetter, 50 μL of the working enzyme stock (for each of the enzyme types tested) was added to each well and then the plate was immediately placed into a plate reader (SpectraMax plate reader with SoftMax Pro 6.0 software, Molecular Devices, Sunnyvale Calif.) and emissions were read using the setting of Excitation 320 nm, Emission 420 nm, with a cut-off of 420 nm. Readings occurred every 1 minute for 15 minutes. Once the plates were completed, they were sealed with an aluminum sealer and stored at −80° C.

To test the FRET pool cleavage by pepsin or simulated human gastric fluid (SGF), the assay buffer was 35 mM NaCl, pH 1.2. The commercially sourced enzyme (Sigma P6887) enzyme was prepared by dissolving 1 mg/ml pepsin in the assay buffer. Pepsin stock was then diluted 1:200 by adding 250 μL of stock enzyme to 50 mL of assay buffer. This working solution was then used for all plate screenings.

To test the FRET pool cleavage by gut or intestinal enzymes of a coleopteran pest, gut enzymes (CELOP) were isolated from Southern Corn Rootworm (*Diabrotica undecimpunctata*). Southern Corn Rootworm were commercially obtained from Crop Characteristics (Farmington, Minn.) as 3rd instar larvae. Insects were anesthetized by placing them on a cold pack for several minutes before the dissection began. To isolate the gut, the posterior end was pinned to a dissection plate and another pin was used to nick the soft tissue behind the head. The pin was inserted behind the head capsule and then pulled away from pinned insect, pulling the digestive tract out of the body with the head. The gut could then be collected. About 20 guts were added to a pre-weighed tube with 100 μL solution of 100 mM PBS pH 5.7 and weighed after to determine the mass of guts added. Gut contents were extracted by vortexing the solution for 1-2 minutes. Tubes were then spun at 15,000 rpm for 1 minute. The liquid layer was then transferred to a 0.2 μm mico-spin filter and spun at 15,000 rcf for 1 minute. The filter was washed with 400 μL of 100 mM PBS buffer pH 5.7 and the permeate from both spins were combined. The sterile filtered gut contents were then diluted to 10 mg/mL in buffer and stored at −20 C. To make a working stock, the gut contents where then diluted 10× by mixing 700 μL stock to 7 mL with assay buffer for each plate. Using a multichannel, repeat pipetter, 50 μL of 1× gut extract was added to each well and read immediately as described above.

To test the FRET pool cleavage by gut enzymes of a lepidopteran pest (LEP), gut enzymes were isolated from Corn Earworm (*Helicoverpa zea*). Corn Earworm insects were obtained commercially from Benzon Research (Carlisle, Pa.) as eggs. Hatched larvae were raised on artificial diet until $4/5^{th}$ instar (20 mm long) before guts were isolated. Before gut extract, larvae were anesthetized using $CO_2$. The larva was then pinned on the dissection plate at both the head and the tail. Using dissection scissors, the cuticle was nicked. The dissection scissors were then inserted into the nick and the cuticle was lengthwise along the insect. The cuticle was then carefully pulled back and pinned open to reveal the digestive track. Using DI water, the insect was thoroughly rinsed to remove hemolymph. The gut was then excised with tweezers and placed in a solution of 500 μL of 200 mM Tris-HCl pH 8.1 150 mM NaCl (assay buffer). The tube was pre-weighed and post-weighed to calculate the total amount of gut added. CEW gut was diluted to a stock concentration of 7 mg/ml (10×) in 200 mM Tris-HCl pH 8.1 150 mM NaCl. This was diluted fresh each plate by 20× with the assay buffer. Using a multichannel, repeat pipetter, 50 μL of 1× gut extract was added to each well and read immediately as described above.

1.1) Protease Cleavage Analysis of FRET Peptide Pools

The FRET kits (Cat. No. PSREPLI005, Mimotopes, Victoria, Australia) were tested against LEP, COLEOP and SGF gut simulated protease environments and data was recovered. There were two types of data (slope of cleavage over time (which is presented as either a raw slope, or as an indexed value where the steepest slope is 100% and each slope is represented as a percentage of the highest slope) and cleaved components) were generated. The first type of data was the slope of fluorescence detection over 10 minutes. The slope of the reaction allowed the ranking of the two or three amino acid sequences for their speed to cleave in the various protease environments. Table 4 shows the top 50 sequences that cleaved for each of the digestive conditions (SGF represents human gastrointestinal environment; COLEOP is the gut environment of Coleoptera insects; and LEP is the gut environment of Lepidopteran insects). Shown in Table 5 are sample sequences that did not cleave in the digestive conditions, and represent an example of sequences outside of the Markush that are not cleavable in the X and Y conditions.

TABLE 4

Representative cleavable sequences from pooled FRET screening for each of the digestive conditions; SGF, COLEOP, and LEP

| Y | | X | | | |
|---|---|---|---|---|---|
| SGF | | COLEOP | | LEP | |
| Sequence | % of Max Slope | Sequence | % of Max Slope | Sequence | % of Max Slope |
| IFF | 100 | IKN | 100 | PKK | 100 |
| IFY | 100 | IKQ | 100 | PKR | 100 |
| IYF | 100 | IRN | 100 | PRK | 100 |
| LFF | 100 | IRQ | 100 | PRR | 100 |
| LFY | 100 | LKN | 100 | VRY | 93 |
| LYF | 100 | LKQ | 100 | AKF | 93 |
| LYY | 100 | LRN | 100 | AKY | 93 |
| FFA | 84 | LRQ | 100 | ARF | 93 |
| FFV | 84 | KIK | 83 | ARY | 93 |
| FYA | 84 | KIR | 83 | VKF | 93 |
| FYV | 84 | KLK | 83 | VKY | 93 |
| YFA | 84 | KLR | 83 | VRF | 93 |
| YFV | 84 | RIK | 83 | RRT | 93 |
| FFI | 78 | RIR | 83 | KKS | 93 |
| FFL | 78 | RLK | 83 | KKT | 93 |
| FYI | 78 | RLR | 83 | KRS | 93 |
| FYL | 78 | NIK | 74 | KRT | 93 |
| YFI | 78 | NIR | 74 | RKS | 93 |
| YFL | 78 | NLK | 74 | RKT | 93 |
| YYL | 78 | NLR | 74 | RRS | 93 |
| AIF | 78 | QIK | 74 | RRY | 92 |
| ALF | 78 | QIR | 74 | KKF | 92 |
| ALY | 78 | QLK | 74 | KKY | 92 |
| VIF | 78 | QLR | 74 | KRF | 92 |
| VLF | 78 | AIK | 70 | KRY | 92 |
| VLY | 78 | AIR | 70 | RKF | 92 |
| DFF | 66 | ALK | 70 | RKY | 92 |
| DFY | 66 | ALR | 70 | RRF | 92 |
| DYF | 66 | VIK | 70 | RTR | 90 |
| EFF | 66 | VIR | 70 | KSK | 90 |
| EFY | 66 | VLK | 70 | KSR | 90 |
| EYF | 66 | VLR | 70 | KTK | 90 |
| IFA | 65 | IKS | 68 | KTR | 90 |
| IFV | 65 | IKT | 68 | RSK | 90 |
| LFA | 65 | IRS | 68 | RSR | 90 |
| LFV | 65 | IRT | 68 | RTK | 90 |
| LYA | 65 | LKS | 68 | VRT | 90 |
| LYV | 65 | LKT | 68 | AKS | 90 |
| AFF | 63 | LRS | 68 | AKT | 90 |
| AFY | 63 | LRT | 68 | ARS | 90 |
| AYF | 63 | INK | 56 | ART | 90 |
| VFF | 63 | INR | 56 | VKS | 90 |
| VFY | 63 | IQK | 56 | VKT | 90 |
| VYF | 63 | IQR | 56 | VRS | 90 |
| IIF | 63 | LNK | 56 | LTR | 89 |
| ILF | 63 | LNR | 56 | ISK | 89 |
| ILY | 63 | LQK | 56 | ISR | 89 |
| LIF | 63 | LQR | 56 | ITK | 89 |
| LIY | 63 | IKA | 56 | ITR | 89 |
| LLF | 63 | IKV | 56 | LSK | 89 |

TABLE 5

Example of 5 failed cleavable sequences from pooled FRET screening for each of the digestive conditions; SGF, COLEOP, and LEP

| Y | | X | | | |
|---|---|---|---|---|---|
| SGF | | COLEOP | | LEP | |
| Sequence | % of Max Slope | Sequence | % of Max Slope | Sequence | % of Max Slope |
| IFF | 0 | IKN | 0 | PKK | 0 |
| IFY | 0 | IKQ | 0 | PKR | 0 |
| IYF | 0 | IRN | 0 | PRK | 0 |

TABLE 5-continued

Example of 5 failed cleavable sequences from pooled FRET screening for each of the digestive conditions; SGF, COLEOP, and LEP

| Y | | X | | | |
|---|---|---|---|---|---|
| SGF | | COLEOP | | LEP | |
| Sequence | % of Max Slope | Sequence | % of Max Slope | Sequence | % of Max Slope |
| LFF | −1 | IRQ | 0 | PRR | 0 |
| LFY | −1 | LKN | −2 | VRY | 0 |

The amino acids represented in the top 5% of wells from each digestive condition were used to create the Markush group that constitutes a binary peptide that comprises of an amino acid sequence selected from the group consisting of: $X_1$-$X_2$-$Y_1$-$Y_2$, $X_1$-$X_2$-$X_3$-$Y_1$-$Y_2$, $X_1$-$X_2$-$X_3$-$X_4$-$Y_1$-$Y_2$, $X_1$-$X_2$-$Y_1$-$Y_2$-$Y_3$, $X_1$-$X_2$-$X_3$-$Y_1$-$Y_2$-$Y_3$, $X_1$-$X_2$-$X_3$-$X_4$-$Y_1$-$Y_2$-$Y_3$, $X_1$-$X_2$-$Y_1$-$Y_2$-$Y_3$-$Y_4$, $X_1$-$X_2$-$X_3$-$Y_1$-$Y_2$-$Y_3$-$Y_4$, $X_1$-$X_2$-$X_3$-$X_4$-$Y_1$-$Y_2$-$Y_3$-$Y_4$, $Y_1$-$Y_2$-$X_1$-$X_2$, $Y_1$-$Y_2$-$X_1$-$X_2$-$X_3$, $Y_1$-$Y_2$-$X_1$-$X_2$-$X_3$-$X_4$, $Y_1$-$Y_2$-$Y_3$-$X_1$-$X_2$, $Y_1$-$Y_2$-$Y_3$-$X_1$-$X_2$-$X_3$, $Y_1$-$Y_2$-$Y_3$-$X_1$-$X_2$-$X_3$-$X_4$, $Y_1$-$Y_2$-$Y_3$-$Y_4$-$X_1$-$X_2$, $Y_1$-$Y_2$-$Y_3$-$Y_4$-$X_1$-$X_2$-$X_3$, and $Y_1$-$Y_2$-$Y_3$-$Y_4$-$X_1$-$X_2$-$X_3$-$X_4$, wherein each Xn and each Yn is an amino acid, and wherein $X_1$ is selected from the group consisting of: (all single letter amino acid format) A, D, E, G, I, K, L, N, P, Q, R, and V; $X_2$ is selected from the group consisting of A, F, G, I, K, L, N, P, Q, R, S, T, V, and Y; $X_3$ is selected from the group consisting of A, D, E, F, G, I, K, L, N, Q, R, S, T, V, and Y; $X_4$ is selected from the group consisting of: R, H, K, D, E, S, T, N, Q, G, A, I, L, M, F, W, Y, and V. In some embodiments, $Y_1$ is selected from the group consisting of: (all single letter amino acid format) A, D, E, F, G, I, L, N, Q, S, T, V, and Y; $Y_2$ is selected from the group consisting of F, G, I, L, and Y; and $Y_3$ is selected from the group consisting of A, D, E, F, G, I, K, L, R, S, T, V, and Y; and $Y_4$ is selected from the group consisting of: R, H, K, D, E, S, T, N, Q, G, A, I, L, M, F, W, Y, and V.

One embodiment of the sequences discovered from SGF (simulated human gut environment) screening, in the XY or YX format, the human gut protease cleavable substrate may include one or more of the following peptides: AFF, AFG, AFI, AFL, AFV, AFY, AGF, AGL, AIF, AIL, ALF, ALG, ALI, ALL, ALY, AYF, AYL, DFF, DFG, DFI, DFL, DFY, DGF, DGL, DIF, DLF, DLG, DLY, DYF, DYL, EFF, EFG, EFI, EFL, EFY, EGF, EGL, EIF, ELF, ELG, ELY, EYF, EYL, FF, FFA, FFD, FFE, FFF, FFG, FFI, FFK, FFL, FFR, FFS, FFT, FFV, FFY, FGA, FGD, FGE, FGF, FGI, FGK, FGL, FGR, FGS, FGT, FGV, FGY, FLV, FLR, FYA, FYD, FYE, FYF, FYG, FYI, FYK, FYL, FYR, FYS, FYT, FYV, FYY, GFA, GFD, GFE, GFF, GFI, GFK, GFL, GFR, GFS, GFT, GFV, GFY, GGL, GIF, GIL, GLF, GLI, GLL, GLY, GYF, GYL, IF, IFA, IFF, IFG, IFI, IFL, IFV, IFY, IGF, IGL, IIF, IIL, ILF, ILG, ILI, ILL, ILY, IYF, IYL, LFA, LFF, LFG, LFI, LFL, LFV, LFY, LG, LGA, LGE, LGF, LGI, LGL, LGV, LGY, LIF, LIG, LII, LIL, LIY, LLF, LLG, LLI, LLL, LLY, LYA, LYF, LYG, LYI, LYL, LYV, LYY, NFF, NFG, NFI, NFL, NFY, NGF, NGL, NIL, NLG, NLI, NLL, NYF, NYL, QFF, QFG, QFI, QFL, QFY, QGF, QGL, QIL, QLG, QLI, QLL, QYF, QYL, SFF, SFG, SFI, SFL, SFY, SGF, SGL, SIF, SIL, SLF, SLG, SLI, SLL, SLY, SYF, SYL, TFF, TFG, TFI, TFL, TFY, TGF, TGL, TIF, TIL, TLF, TLG, TLI, TLL, TLY, TYF, TYL, VFF, VFG, VFI, VFL, VFY, VGF, VGL, VIF, VIL, VLF, VLG, VLI, VLL, VLY, VYF, VYL, YFA, YFD, YFE, YFF, YFG, YFI, YFK, YFL, YFR, YFS, YFT, YFV, YFY, YGF, YGL, YYF, YYL.

Another embodiment of the sequences discovered from SGF screening, Y SGF cleavable peptides may include one or more of: AFF, AFI, AFL, AFY, AIF, AIL, ALF, ALI, ALL, ALY, AYF, AYL, DFF, DFI, DFL, DFY, DIF, DLF, DLY, DYF, DYL, YFL, EFF, EFI, EFL, 0, EFY, EIF, ELF, ELY, EYF, EYL, FFA, FFD, FFE, FFF, FFI, FFK, FFL, FFR, FFS, FFT, FFV, FFY, FYA, FYD, FYE, FYF, FYI, FYK, FYL, FYR, FYS, FYT, FYV, FYY, IFA, IFF, IFI, IFL, IFV, IFY, IIF, IIL, ILF, ILI, ILL, ILY, IYF, IYL, LFA, LFF, LFI, LFL, LFV, LFY, LIF, LII, LIL, LIY, LLF, LLI, LLL, LLY, LYA, LYF, LYI, LYL, LYV, LYY, NFF, NFI, NFL, NFY, NIL, NLI, NLL, NYF, NYL, QFF, QFI, QFL, QFY, QIL, QLI, QLL, QYF, QYL, SFF, SFI, SFL, SFY, SIF, SIL, SLF, SLI, SLL, SLY, SYF, SYL, TFF, TFI, TFL, TFY, TIF, TIL, TLF, TLI, TLL, TLY, TYF, TYL, VFF, VFI, VFL, VFY, VIF, VIL, VLF, VLI, VLL, VLY, VYF, VYL, YFA, YFD, YFE, YFF, YFI, YFK, YFL, YFR, YFS, YFT, YFV, YFY, YYF, YYL.

In some embodiments, exemplary sequences discovered from insect cleavability, the X region may include one or more insect and/or nematode gut protease cleavable peptide sequences: AAG, AAK, AAR, AFG, AFK, AFR, AGF, AGI, AGK, AGL, AGN, AGQ, AGR, AGS, AGT, AGY, AIG, AIK, AIN, AIQ, AIR, AKF, AKG, AM, AKK, AKL, AKN, AKQ, AKR, AKS, AKT, AKY, ALG, ALK, ALN, ALQ, ALR, APF, APG, APK, APR, ARF, ARG, ARI, ARK, ARL, ARN, ARQ, ARR, ARS, ART, ARY, ASG, ASK, ASR, ATG, ATK, ATR, AVG, AVK, AVR, AYG, AYK, AYR, DGK, DGR, DIG, DIK, DIR, DLG, DLK, DLR, EGK, EGR, EIG, EIK, EIR, ELG, ELK, ELR, ER, FVR, GAF, GAI, GAK, GAL, GAR, GAY, GFK, GFR, GIK, GIN, GIQ, GIR, GKA, GKD, GKE, GKF, GM, GKK, GKL, GKN, GKQ, GKR, GKS, GKT, GKV, GKY, GLK, GLN, GLQ, GLR, GNA, GNK, GNR, GNV, GPK, GPR, GQA, GQK, GQR, GQV, GRA, GRD, GRE, GRF, GRI, GRK, GRL, GRN, GRQ, GRR, GRS, GRT, GRV, GRY, GSI, GSK, GSL, GSR, GTI, GTK, GTL, GTR, GVF, GVI, GVK, GVL, GVR, GVY, GYK, GYR, IGA, IGF, IGI, IGK, IGL, IGN, IGQ, IGR, IGS, IGT, IGV, IGY, IIG, IIK, IIR, IKA, IKF, IKG, IM, IKK, IKL, IKN, IKQ, IKR, IKS, IKT, IKV, IKY, ILG, ILK, ILR, INA, ING, INK, INR, INV, IPG, IPK, IPR, IQA, IQG, IQK, IQR, IQV, IRA, IRF, IRG, IRI, IRK, IRL, IRN, IRQ, IRR, IRS, IRT, IRV, IRY, ISG, ISK, ISR, ITG, ITK, ITR, KAF, KAG, KAI, KAK, KAL, KAR, KAY, KFF, KFG, KFK, KFR, KGA, KGD, KGE, KGF, KGI, KGK, KGL, KGN, KGQ, KGR, KGS, KGT, KGV, KGY, MG, MK, KIN, MQ, MR, KKA, KKD, KKE, KKF, KKG, KKN, KKQ, KKS, KKT, KKV, KKY, KLG, KLK, KLN, KLQ, KLR, KNG, KNK, KNR, KPG, KPK, KPR, KQG, KQK, KQR, KRA, KRD, KRE, KRF, KRG, KRN, KRQ, KRS, KRT, KRV, KRY, KSG, KSI, KSK, KSL, KSR, KTG, KTI, KTK, KTL, KTR, KVF, KVG, KVI, KVK, KVL, KVR, KVY, KYG, KYK, KYR, LFR, LGA, LGF, LGI, LGK, LGL, LGN, LGQ, LGR, LGS, LGT, LGV, LGY, LIG, LIK, LIR, LK, LKA, LKF, LKG, LKI, LKK, LKL, LKN, LKQ, LKR, LKS, LKT, LKV, LKY, LLG, LLK, LLR, LNA, LNG, LNK, LNR, LNV, LPG, LPK, LPR, LQA, LQG, LQK, LQR, LQV, LRA, LRF, LRG, LRI, LRK, LRL, LRN, LRQ, LRR, LRS, LRT, LRV, LRY, LSG, LSK, LSR, LTG, LTK, LTR, NGK, NGR, NIG, NIK, NIR, NLG, NLK, NLR, PGK, PGR, PIG, PIK, PIR, PKG, PKK, PKR, PLG, PLK, PLR, PRG, PRK, PRR, QGK, QGR, QIG, QIK, QIR, QLG, QLK, QLR, RAF, RAG, RAI, RAK, RAL, RAR, RAY, RFF, RFG, RFK, RFR, RGA, RGD, RGE, RGF, RGI, RGK, RGL, RGN, RGQ, RGR, RGS, RGT, RGV, RGY, RIG, RIK, RIN, RIQ, RIR, RKA, RKD, RKE, RKF, RKG, RKK, RKN, RKQ, RKS, RKT, RKV, RKY, RLF, RLFL, RLG, RLK, RLN, RLQ, RLR, RNG, RNK, RNR, RPG, RPK, RPR, RQG, RQK, RQR, RRA, RRD, RRE, RRF, RRG, RRK, RRN, RRQ, RRR, RRS, RRT, RRV, RRY, RSG, RSI, RSK, RSL, RSR, RTG, RTI, RTK, RTL, RTR, RVF, RVG, RVI, RVK, RVL, RVR, RVY, RYG, RYK, RYR, VAG, VAK, VAR, VFG, VFK, VFR, VGF, VGI, VGK, VGL, VGN, VGQ, VGR, VGS, VGT, VGY, VIG, VIK, VIN, VIQ, VIR, VKF, VKG, VKI, VKK, VKL, VKN, VKQ, VKR, VKS, VKT, VKY, VLG, VLK, VLN, VLQ, VLR, VPG, VPK, VPR, VR, VRF, VRG, VRI, VRK, VRL, VRN, VRQ, VRR, VRS, VRT, VRY, VSG, VSK, VSR, VTG, VTK, VTR, VVG, VVK, VVR, VYG, VYK, VYR.

In another embodiment of the sequences discovered from insect cleavability, the X region may include one or more insect and/or nematode gut protease cleavable peptide sequences: AAK, AAR, AFK, AFR, AIK, AIN, AIQ, AIR, AKF, AKI, AKK, AKL, AKN, AKQ, AKR, AKS, AKT, AKY, ALK, ALN, ALQ, ALR, APK, APR, ARF, ARI, ARK, ARL, ARN, ARQ, ARR, ARS, ART, ARY, ASK, ASR, ATK, ATR, AVK, AVR, AYK, AYR, DIK, DIR, DLK, DLR, EIK, EIR, ELK, ELR, IIK, IIR, IKA, IKF, IKI, IKK, IKL, IKN, IKQ, IKR, IKS, IKT, IKV, IKY, ILK, ILR, INA, INK, INR, INV, IPK, IPR, IQA, IQK, IQR, IQV, IRA, IRF, IRI, IRK, IRL, IRN, IRQ, IRR, IRS, IRT, IRV, IRY, ISK, ISR, ITK, ITR, KAF, KAI, KAK, KAL, KAR, KAY, KFK, KFR, KIK, KIN, KIQ, KIR, KKA, KKD, KKE, KKF, KKN, KKQ, KKS, KKT, KKV, KKY, KLK, KLN, KLQ, KLR, KNK, KNR, KPK, KPR, KQK, KQR, KRA, KRD, KRE, KRF, KRN, KRQ, KRS, KRT, KRV, KRY, KSI, KSK, KSL, KSR, KTI, KTK, KTL, KTR, KVF, KVI, KVK, KVL, KVR, KVY, KYK, KYR, LIK, LIR, LKA, LKF, LKI, LKK, LKL, LKN, LKQ, LKR, LKS, LKT, LKV, LKY, LLK, LLR, LNA, LNK, LNR, LNV, LPK, LPR, LQA, LQK, LQR, LQV, LRA, LRF, LRI, LRK, LRL, LRN, LRQ, LRR, LRS, LRT, LRV, LRY, LSK, LSR, LTK, LTR, NIK, NIR, NLK, NLR, PIK, PIR, PKK, PKR, PLK, PLR, PRK, PRR, QIK, QIR, QLK, QLR, RAF, RAI, RAK, RAL, RAR, RAY, RFK, RFR, RIK, RIN, RIQ, RIR, RKA, RKD, RKE, RKF, RKN, RKQ, RKS, RKT, RKV, RKY, RLK, RLN, RLQ, RLR, RNK, RNR, RPK, RPR, RQK, RQR, RRA, RRD, RRE, RRF, RRN, RRQ, RRS, RRT, RRV, RRY, RSI, RSK, RSL, RSR, RTI, RTK, RTL, RTR, RVF, RVI, RVK, RVL, RVR, RVY, RYK, RYR, VAK, VAR, VFK, VFR, VIK, VIN, VIQ, VIR, VKF, VKI, VKK, VKL, VKN, VKQ, VKR, VKS, VKT, VKY, VLK, VLN, VLQ, VLR, VPK, VPR, VRF, VRI, VRK, VRL, VRN, VRQ, VRR, VRS, VRT, VRY, VSK, VSR, VTK, VTR, VVK, VVR, VYK, VYR.

The lack of numerous common sequences that meet the both high ranked X and Y cleavability conditions led to the merging of the sequences discovered in the X and Y categories to build binary and tertiary peptides. This research was called Round 2 and involved combinations from the Round 1 data, above. One way this was tested involved several combinations of insect cleavable and SGF cleavable sequences (X and Y regions respecdesigned and ordered to be synthesized as FRET molecules. Another way this was tested involved the combinations of insect cleavable and SGF cleavable sequences designed and ordered to be synthesized as DNA encoding the ERSP-STA-(TP-L)$_n$ protein for transient plant expression. Both FRET and transient expressed proteins were used to exemplify the insect cleavable and SGF cleavable nature of the binary and tertiary peptides.

Round 2 data from FRET molecules that represented a subset of binary combinations based on the observed top hits in Round 1 provided a hierarchical ranking of the various binary combinations. Round 2 FRET molecules were synthesized, resuspended, and tested in cleavage enzyme assays as described above in Round 1. Many combinations of binary cleavable linking peptides were tested against LEP, COLEOP and SGF conditions.

Transiently expressed protein from DNA encoding variation of these the ERSP-STA-(TP-L)n protein where L is binary and tertiary peptide based on Round 2 data, and was also treated with the same cleavage enzymes (LEP, COLEOP and SGF).

Data that embodies Round 2 FRET experiment is listed below in section 1.1. Data that embodies Round 2 plant expression system in listed in section 1.2. The amino acid sequences listed in SEQ ID NOs: 1594-1758 were synthesized as either/or FRET and transient plant expression.

(SEQ ID NO: 1649)
AFVRLFGS, (SEQ ID NO: 1650)
AKLFVGS, (SEQ ID NO: 1651)
ALFALKGS, (SEQ ID NO: 1652)
ALFLKGS, (SEQ ID NO: 1653)
ALFLRGS, (SEQ ID NO: 1654)
ALFRGS, (SEQ ID NO: 1655)
ALFRLRGS, (SEQ ID NO: 1656)
ALKALFGS, (SEQ ID NO: 1657)
ALKFFGS, (SEQ ID NO: 1658)
ALKFLVGS, (SEQ ID NO: 1659)
ALKIFVGS, (SEQ ID NO: 1660)
ALKLFVGS, (SEQ ID NO: 1661)
FFADIKGS, (SEQ ID NO: 1662)
FFALKGS, (SEQ ID NO: 1663)
FFLKGS, (SEQ ID NO: 1664)
FFLRGS, (SEQ ID NO: 1665)
FFRLRGS, (SEQ ID NO: 1666)
FGYRIKGS, (SEQ ID NO: 1667)
FLRLFGS, (SEQ ID NO: 1668)
FYARRGS, (SEQ ID NO: 1669)
GGLRKKGS,

-continued (SEQ ID NO: 1670)
IFVALKGS, (SEQ ID NO: 1671)
IFVLKGS, (SEQ ID NO: 1672)
IFVLRGS, (SEQ ID NO: 1673)
IFVRGS, (SEQ ID NO: 1674)
IFVRLRGS, (SEQ ID NO: 1675)
ILFNIKGS, (SEQ ID NO: 1676)
LFAAPFGS, (SEQ ID NO: 1677)
LFVALKGS, (SEQ ID NO: 1678)
LFVLKGS, (SEQ ID NO: 1679)
LFVLRGS, (SEQ ID NO: 1680)
LFVRGS, (SEQ ID NO: 1681)
LFVRLRGS, (SEQ ID NO: 1682)
LFVRVFLGS, (SEQ ID NO: 1683)
LGERGS, (SEQ ID NO: 1684)
LKALFGS, (SEQ ID NO: 1685)
LKFFGS, (SEQ ID NO: 1686)
LKIFVGS, (SEQ ID NO: 1687)
LKLFVGS, (SEQ ID NO: 1688)
LRALFGS, (SEQ ID NO: 1689)
LRFFGS, (SEQ ID NO: 1690)
LRIFVGS, (SEQ ID NO: 1691)
LRLFVGS, (SEQ ID NO: 1692)
RALFGS, (SEQ ID NO: 1693)
RIFVGS, (SEQ ID NO: 1694)
RLFVGS, (SEQ ID NO: 1695)
RLRALFGS, (SEQ ID NO: 1696)
RLRFFGS, -continued (SEQ ID NO: 1697)
RLRIFVGS, (SEQ ID NO: 1698)
RLRLFVGS, (SEQ ID NO: 1699)
RRKAFVGS, (SEQ ID NO: 1700)
RRKLIFGS, (SEQ ID NO: 1701)
RRRFFAGS, (SEQ ID NO: 1702)
VFGRKGGS, (SEQ ID NO: 1703)
YFVRKGS.

Data from the Round 2 FRET that exemplifies the combination of both X and Y cleavability in a binary or tertiary peptide are presented in Table 6.

TABLE 6

Representative sequences for X-Y combinations showing cleavability in both X and Y cleavage conditions

| | % of Max Slope | |
|---|---|---|
| Sequence | X | Y |
| IFVALKGS | 69 | 88 |
| ALKLFVGS | 100 | 88 |
| LFVALKGS | 92 | 76 |
| LRLFVGS | 74 | 75 |
| LFVRLRGS | 94 | 74 |
| LKLFVGS | 98 | 67 |

Example 3. Plant Protein Expression Testing of the Candidate Binary/Tertiary Cleavable Linking Peptides The cloning and expression of a proteins containing multiple copies of TP intervened by binary or tertiary cleavable linking peptides was performed using a tobacco transient expression system technology referred to as FECT (Liu Z & Kearney CM, BMC Biotechnology, 2010, 10:88, the disclosure of which is incorporated herein by reference in its entirety). The FECT vector contains a T-DNA region for agroinfection, which contains a CaMV 35S promoter that drives the expression of the foxtail mosaic virus RNA without the genes encoding the viral coating protein and the triple gene block. In the place of the coating protein and triple block are a pair of subcloning sites (PacI and AvrII) that allow an ORF to be subcloned N' to C' following the PacI site for high levels of transient viral expression. This “disarmed” virus genome prevents plant to plant transmission. In addition to the FECT vector subcloned to express the various proteins with TP intervened by binary or tertiary cleavable linking peptides, a second FECT vector is co-expressed that encodes P19, a RNA silencing suppressor protein from tomato bushy stunt virus, to prevent the post-transcriptional gene silencing (PTGS) of the introduced T-DNA. *Agrobacterium* containing the transient plant expression system are injected into the leaves of tobacco (*Nicotiana benthamiana*) as described below.

With reference to FIGS. 2-5, various designs of the insecticidal and/or nematicidal proteins and DNA construct encoding insecticidal and/or nematicidal proteins are illustrated. In some examples, a TP repeat with intervening binary or tertiary cleavable linking peptides is shown. An illustrative ERSP motif which can be used in accordance with the exemplary embodiments provided here is the Barley Alpha-Amylase Signal peptide (BAAS), which is comprised of 24 Amino acids as shown below (N' to C', one letter code):

```
(SEQ ID NO: 4)
MANKHLSLSLFLVLLGLSASLASG.
```

The *Zea mays* ubiquitin monomer used in some of the proteins was comprised of 75 Amino acids as shown below (N' to C', one letter code):

```
QIFVKTLTGKTITLEVESSDTIDNVKAKIQDKEGIPPDQQRLIFAGKQLE
DGRTLADYNIQKESTLHLVLRLRGG (Accession Number
XP_020404049.1, SEQ ID NO: 1759).
```

An exemplary TP useful in the example described here can include: U-ACTX-Hv1a, which has the following amino acid sequence (N' to C', one letter code): QYCVPVDQPCSLNTQPCCD-DATCTQERNENGHTVYYCRA (SEQ ID NO: 6) or U+2-ACTX-Hv1a, which has the following amino acid sequence (N' to C', one letter code):

```
(SEQ ID NO: 5)
GSQYCVPVDQPCSLNTQPCCDDATCTQERNENGHTVYYCRA.
```

In separate examples, three different intervening binary or tertiary cleavable linking peptides (denoted by the short hand form L1-L4) were used (N' to C', one letter code):

```
(L1)
(SEQ ID NO: 1)
IGER

(L2)
(SEQ ID NO: 1660)
ALKLFVGS

(L3)
(SEQ ID NO: 1674)
IFVRLRGS

(L4)
(SEQ ID NO: 1658)
ALKFLVGS.
```

Figure 6A:
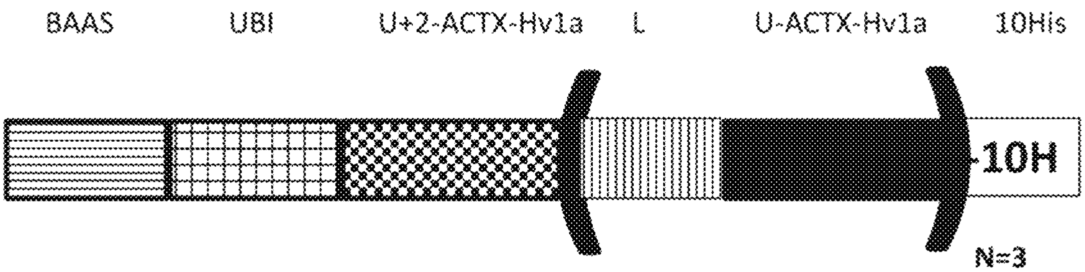
FIG. 6A depicts an illustrative insecticidal and/or nematicidal protein comprising a BAAS ERSP, fused in frame to ubiquitin which is fused to a U+2-ACTX-Hv1a TP which is fused to 3 L-TP fusion constructs (each repeating construct comprising a linking cleavable peptide L, wherein L is a tertiary cleavable linking peptide, having three regions (XYZ), and wherein the Z region is the dipeptide glycine-serine GS, and the TP is a U-ACTX-Hv1a) and where the last TP U-ACTX-Hv1a has a fused 10 His tag.
Figure 6B:
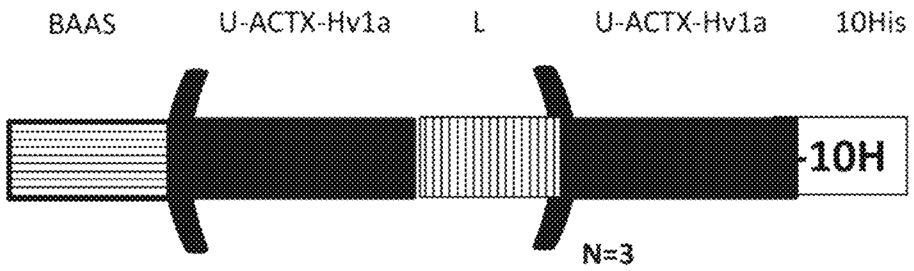
FIG. 6B depicts an illustrative insecticidal and/or nematicidal protein comprising a BAAS ERSP, fused in frame to a 3 repeating construct, the construct comprising a U-ACTX-Hv1a TP fused to a linker (L) which may be a binary or tertiary cleavable linking peptide. The last U-ACTX-Hv1a TP has a 10 His tag.
Figure 6C:
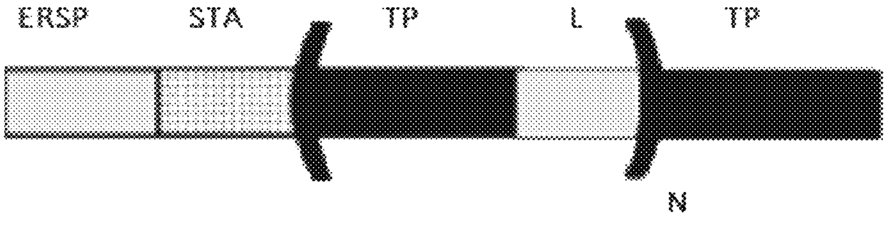
FIG. 6C depicts a graphical representation of an illustrative insecticidal and/or nematicidal protein shown in the form of a construct, wherein each depiction of the ERSP, STA, $(TP-L)_N$ and TP are fused in frame. In this construct, ERSP is fused to the N-terminus of a STA domain, which is fused to a repeating construct, the construct comprises units of TP fused to a linker peptide (L), wherein each TP in the repeating construct may be the same or different and each L in the repeating construct may be the same or different. Finally, the last repeating unit of the TP-L construct is fused to the N-terminus of a TP. In this exemplary embodiment, N can be 1 to 10 repeating units, for example, 1, 2, 3, 4, 5, 6, 7, 8, 9, or 10 units, such that upon cleavage in an insect and/or nematode gut environment, each L is cleaved, thus releasing multiple copies of TP which is insecticidal and/or nematicidal to the insect or nematode that ingested the insecticidal and/or nematicidal protein.

In addition, a histidine tag, which has the following amino acid sequence (N' to C', one letter code): HHHHHHHHHH (SEQ ID NO: 1760) is used as part of the constructed insecticidal and/or nematicidal protein. The following insecticidal and/or nematicidal proteins: BAAS:UBI:U+2-ACTX-Hv1a: (L: U-ACTX-Hv1a)$_3$:His10 and BAAS: (U-ACTX-Hv1a: L)$_3$:U-ACTX-Hv1a:H10 ORF DNAs (where BAAS is the ERSP; and L is a binary or tertiary cleavable linking peptide) as schematically shown in FIGS. 6A and 6B, were cloned into the Pac I and Avr II restriction sites of the FECT expression vector to create the transient vectors which were then transformed into *Agrobacterium tumefaciens* strain, GV3101 cells using a freeze-thaw method as follows: the stored competent GV3101 cells were thawed on ice and then mixed with 1-5 pg pure transient vectors DNA. The cell-DNA mixture was then kept on ice for 5 minutes, then transferred to −80° C. for 5 minutes, and then incubated in a 37° C. water bath for 5 minutes. The freeze-thaw treated cells were then diluted into 1 mL LB medium and shaken on a rocking table for 2-4 hours at room temperature. Cell-LB mixture was then spun down at 5,000 rcf for 2 minutes to pellet cells and then 800 μL of LB supernatant is removed. The cells are then resuspended in the remaining liquid and the entire volume, approximately 200 μL, of the transformed cell-LB mixture was then spread onto LB agar plates with the appropriate antibiotics (10 pg/mL rifampicin, 25 μg/mL gentamycin, and 50 μg/mL kanamycin) and incubated at 28° C. for two days. Resulting transformed colonies were then picked and culture in 6 mL aliquots of LB medium with the appropriate antibiotics for transformed DNA analysis and making glycerol stocks of the transformed GV3101 cells.

The transformed GV3101 cells were streaked onto an LB plate with the appropriate antibiotics (as described above) from their glycerol stock and incubated at 28° C. for two days. A colony of transformed GV3101 cells was used to inoculate 5 mL of LB-MESA medium (LB media supplemented with 10 mM MES, 20 μM acetosyringone) and the same antibiotics described above, and grown overnight at 28° C. The cells of the overnight culture were collected by centrifugation at 5000 rpm for 10 minutes and resuspended in the induction medium (10 mM MES, 10 mM MgCl2, 100 μM acetosyringone) at a final OD600 of 1.0. The cells were then incubated in the induction medium for 2 hours to overnight at room temperature and were then ready for transient transformation of tobacco leaves. Because FECT uses a mixture of P19 expression and the gene of interest expression, cultures of cells for the pFECT-P19 transformed GV3101 cells and the gene of interest cultures were mixed together in equal amounts for infiltration of tobacco leaves before injection into the plant leaves. The treated cells were infiltrated into the underside of attached leaves of *Nicotiana benthamiana* plants by injection, using a 3 mL syringe without a needle attached. Protein expression in tobacco leaves was evaluated at 6-8 days post-infiltration.

Full length gene-of-interest proteins were purified from the tobacco by using a syringe vacuum extraction technique. The leaf tissue was rolled up and placed inside the barrel of a 60 mL syringe with the needle port capped along with 10 mL of buffer (35 mM NaCl, 5 mM EDTA, 1 Roche cOmplete Tab protease inhibitor tab, pH 1.2 using HCl). The plunger was then inserted into the barrel, inverted so the needle port was up, the cap was removed and excess air was removed by forcing the plunger in. Once the majority of the air had been removed, the syringe was capped and the plunger was pulled back as far as possible, creating a vacuum, and held for 30 seconds. The vacuum was then slowly released by allowing the plunger to go back to the point in which there is no vacuum. This was then repeated three more times. After the third time, the liquid was then expelled out of the syringe by applying light pressure to the leaves, the liquid was saved, and the process was repeated again before the leaves were discarded. The extracted liquid was then sterile filtered using a Pall 0.2 μm Nylon syringe filter and then concentrated in a GE Healthcare Viva Spin 500, 10K mwco rinsing samples with an additional 20 mL of the buffer and spinning the samples down until they were concentrated about 30×.

The samples were then analyzed using standard Western Blotting techniques. Samples were prepared for a protein gel by mixing 10 μL of protein sample with 9 μL Invitrogen 2×SDS loading buffer and 2 μL Novex 10× Reducing agent and heating the sample at 85° C. for 5 minutes. The samples were then loaded and ran on a Novex Precast, 16% Tricine gel in 1× Invitrogen Tricine running buffer with 0.1% sodium thioglycolate in the top tank. The gel was run at 150V for 75 minutes. The gel was then transferred to a Novel PVDF membrane using a 7-minute transfer program on the iBLOT system. Once the transfer was complete, the blot membrane was then moved to a container and washed with Buffer A (1×TBS made from Quality Biological's 10×TBS (0.25M tris base, 1.37M NaCl, 0.03M KCL, pH 7.4)), for five minutes by rocking gently at room temperature. This was then followed with a blocking step using Buffer B (Buffer A with 1% BSA) for 1 hour. The blot was then rinsed three times with 5 minute washes of Buffer C (Buffer B with 0.05% Tween 20). This was followed with a 1:10000 dilution of Maine Biotech Anti-His antibody in Buffer C for 1 hour. The blot was then rinsed three times with Buffer C for 5 minutes each. This was followed with a 1:3000 dilution of BioRad goat anti-mouse AP conjugated antibody (secondary antibody) in Buffer C for 1 hour. The blot was then rinsed with two times with Buffer C for 5 minutes each and once with Buffer A for 5 minutes. The blot is then developed with BioRad AP developer and stopped by rinsing with water. The bands for the concentrated samples were then verified and diluted to make the bands similar in intensities/concentrations. The concentration of the samples was then also validated via iELISA to be between 10-20 ng/ul.

Indirect ELISA (iELISA) assay was performed as follows to quantitatively evaluate the ICK motif TP from the tobacco leaves transiently transformed with the FECT expression systems. 1 μL of the leaf extracted protein was diluted into 99 μL CB2 solution (Immunochemistry Technologies) in the well of an Immulon 2HD 96-well plate, with serial dilutions performed as necessary. Leaf proteins were from the extract samples were then allowed to coat the well walls for 3 hours in the dark at room temperature, and then the CB2 solution was removed, and each well was washed twice with 200 μL PBS (Gibco). 150 μL blocking solution (Block BSA in PBS with 5% non-fat dry milk) was then added into each well and incubated for 1 hour, in the dark, at room temperature. After the removal of the blocking solution and a PBS wash off the wells, 100 μL of rabbit anti-U-ACTX-Hv1a antibody (primary antibody) (1:250 dilution in blocking solution) was added to each well and incubated for 1 hour in the dark at room temperature. The primary antibody was then removed and each well was washed with PBS 4 times. Then 100 μL of HRP-conjugated goat anti-rabbit antibody (secondary antibody, used at 1:1000 dilution in the blocking solution) was added into each well and incubated for 1 hour in the dark at room temperature. After removal of the secondary antibody and wash of the wells with PBS, 100 μL substrate solution (a 1:1 mixture of ABTS peroxidase substrate solution A and solution B, KPL) was added to each well, and the chromogenic reaction was allowed to go until sufficient color development was apparent. Then 100 μL of peroxidase stop solution was added to each well to stop the reaction. The light absorbance of each reaction mixture in the plate was read at 405 nm using a SpectroMax-M2 plate reader, with SoftMax Pro used as control software. Serially diluted known concentrations of pure U-ACTX-Hv1a samples were treated in the same manner as described above in the iELISA assay to generate a mass-absorbance standard curve for quantities analysis.

To determine pepsin cleavability of the Linkers, the peptides are digested with simulated gastric fluid (SGF, 35 mM NaCl, pH 1.2 with lmg/ml pepsin from porcine gastric mucosa). Purified protein samples were mixed with 1:3, SGF:protein (v:v) and were incubated shaking at 37° C. A sample is taken at 0, 2 and 10 minutes immediately prepared for a protein gel (see above). The samples were then run on a Western Blot using the technique described above. See FIG. 6.

To determine insect cleavability of the binary/tertiary peptides, the proteins were digested with gut extract isolated from Southern Corn Rootworm (*Diabrotica undecimpunctata*). Isolation of the gut contents is explained in Example A.1. Prior to peptide digestion, the proteins were buffer exchanged into 100 mM Phosphate buffer, 150 mM NaCl, pH 5.83 using a GE Healthcare Viva Spin 20 returning the final volume to the same as the starting volume. Digests were carried out using SCR gut extract at a 1:3 dilution of SCR gut extract stock:protein (v:v) shaking at 500 rpm, 25° C. Samples were taken at 0, 30 and 210 minutes. Samples were then prepared for SDS-PAGE and western blot as described above.

The binary/tertiary peptides were also tested for cleavability against CEW gut extract (described in Example A.1). The peptides were buffer exchanged, just like they were for the SCR assay above, into 200 mM Tris-HCl pH 8.1 150 mM NaCl. The assay conditions are repeated as listed above for SCR gut extract digest.

These protocols resulted in the creation and validation of candidate tertiary cleavable linking peptides intervening copies of a TP expressed in plant. Additional spacers to enhance cleavability were desired and they are detailed in section 1.3.

Example 4. FRET Research and Spacers that Make Multiple Candidate Tertiary Cleavable Linking Peptides From the experiments performed and described above two exemplary effective binary peptides, ALKLFV (SEQ ID NO: 1605) and IFVRLR (SEQ ID NO: 1619), gave rapid SGF cleavage and rapid LEP and COLEOP cleavage of the peptides in human (SGF) and insect (LEP) and (COLEOP) simulated gut environments.

In order for the binary cleavable linking peptide to cleave, a proteolytic enzyme has to be able to recognize and land on the recognized sequence. If the space is tight or too small, it may cause slower or lower digesting efficiency. By making the binary peptide a tertiary peptide using the most favorable amino acids for the conditions, the speed in which the peptides cleave should increase. The use of "spacers" allows for such increased peptidase cleavage and increased insecticidal activity.

Spacers

To screen for potential spacers, FRET peptides were ordered as the binary peptide ALKLFVZ1Z2 and varied amino acids in positions Z1 and Z2. Some of the amino acids were screened as individuals and some were screened as pools. The peptides were re-suspended using 50% acetonitrile in water at a concentration of 2 μM of each peptide. For the one containing more than one FRET peptide, they were re-suspended so that each peptide was as 2 μM (assuming an equal portion of each one). These were then re-suspended and screened as described above for Round 1. The data does confirm that some amino acids in the Z position are more favorable than others. Table 7 shows representative amino acids for $Z_1$ and $Z_2$ based on the FRET peptide speed to cleave data. The greater the value of the slope in in Table 7 the greater the activity of the amino acid when part of a spacer. The column in Table 7 labeled "Slope" indicates the speed of cleavage of the Linker.

TABLE 7

Representative spacer sequences for increasing speed to cleave for both X and Y conditions with binary peptide ALKLFV

| Spacer sequence | Y Slope | X Slope |
|---|---|---|
| AM | 23461 | 13328 |
| LH | 36648 | 6278 |
| MN | 27088 | 3981 |
| ES | 24393 | 7394 |
| WQ | 26735 | 6880 |
| DT | 24393 | 7394 |
| Sequences that decreased speed to cleave | | |
| PG | 1925 | −79 |
| IF | −5662 | −3064 |

Figure 7:
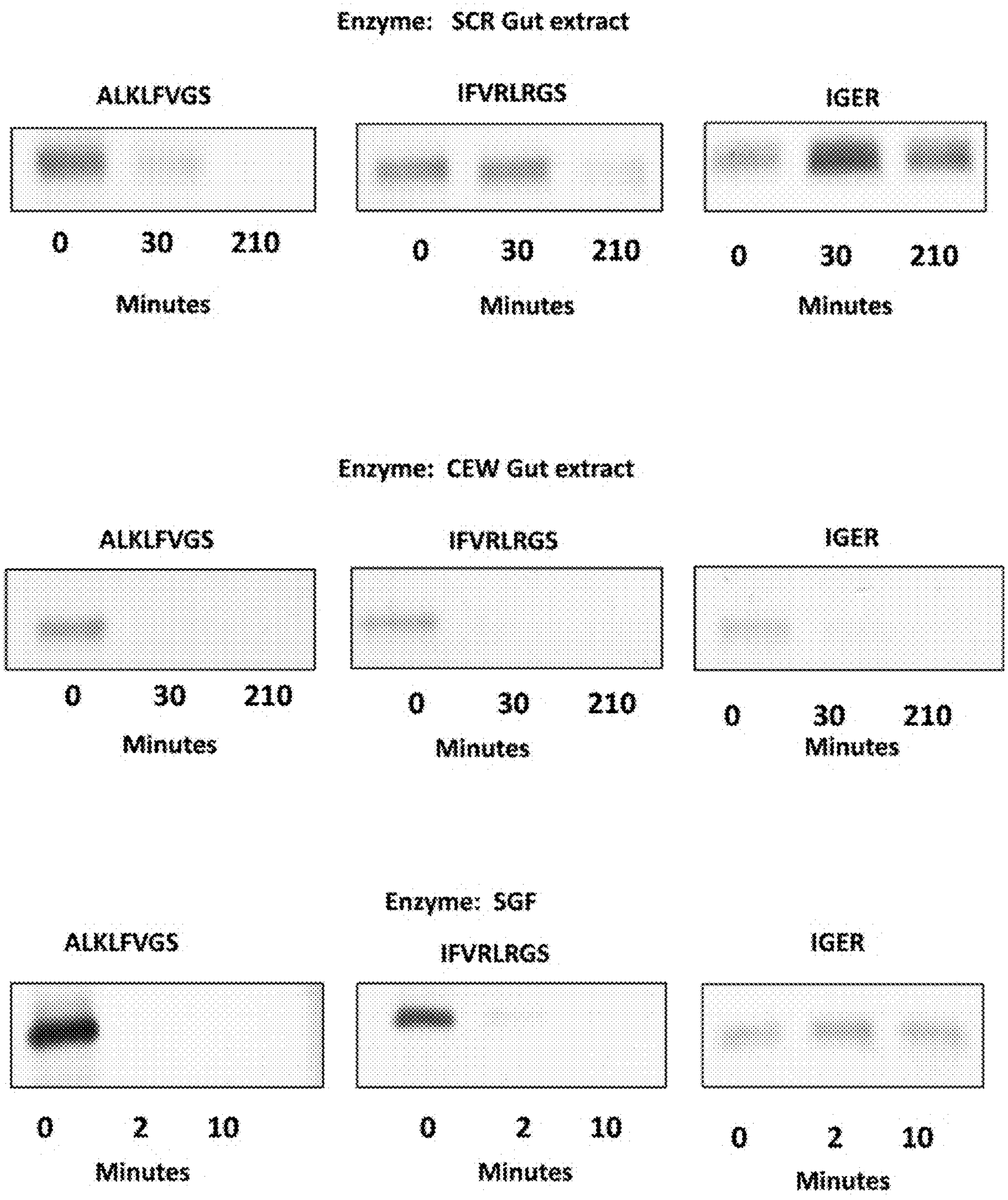
FIG. 7. Demonstration of detection of cleavage of the tertiary linking peptides, ALKLFVGS (SEQ ID NO: 1660) and IFVRLRGS (SEQ ID NO: 1674), in all digestive enzyme conditions compared to the control peptide, IGER (SEQ ID NO:1), which only cleaves in the CEW gut extract. This figure contains the three digestive enzyme conditions (rows) and three different proteins (columns) that each contain four TP units (U-ACTX-Hv1a) with intervening tertiary linking peptides or the control peptide, IGER (SEQ ID NO:1). The cleavage reactions are stopped by the addition of denaturing conditions (chemical and heat) at the time points listed below each gel image. A His-tagged western blot detection illustrates the digestion and disappearance of the protein band for tertiary peptides ALKLFVGS (SEQ ID NO: 1660) and IFVRLRGS (SEQ ID NO:1674) in all digestive conditions, or the retention of the intact protein band across the time points for the control peptide IGER (SEQ ID NO:1) in both the SCR gut extract and SGF.

An example of the gene construction for the transient Tobacco expression system can be seen in FIGS. 6A and 6B. For example shown in FIG. 6A, the Linker sequences ALKLFVGS (SEQ ID NO: 1660) and IFVRLRGS (SEQ ID NO: 1674) are represented in portions of FIG. 6A as (L). In gels, FIG. 7, these show as 2 top bands for intact 4× (w & w/o Ubiquitin). Example Linker sequence IGER (SEQ ID NO:1) is represented by portions of FIG. 6B. In gels it shows as 1 top band for intact 4×.

Example 5. Cloning and Expression of an Insecticidal Transgenic Protein Containing Binary and Tertiary Cleavable Linking Peptides This example details an example of methods to recover a transgenic corn plant with the stable expression of an insecticidal and/or nematicidal protein containing binary and tertiary cleavable linking peptides and a TP. There are three components to making in this example: (1) vector design, (2) plant transformation and regeneration, and (3) validation of expression of the intact protein.

Figure 8:
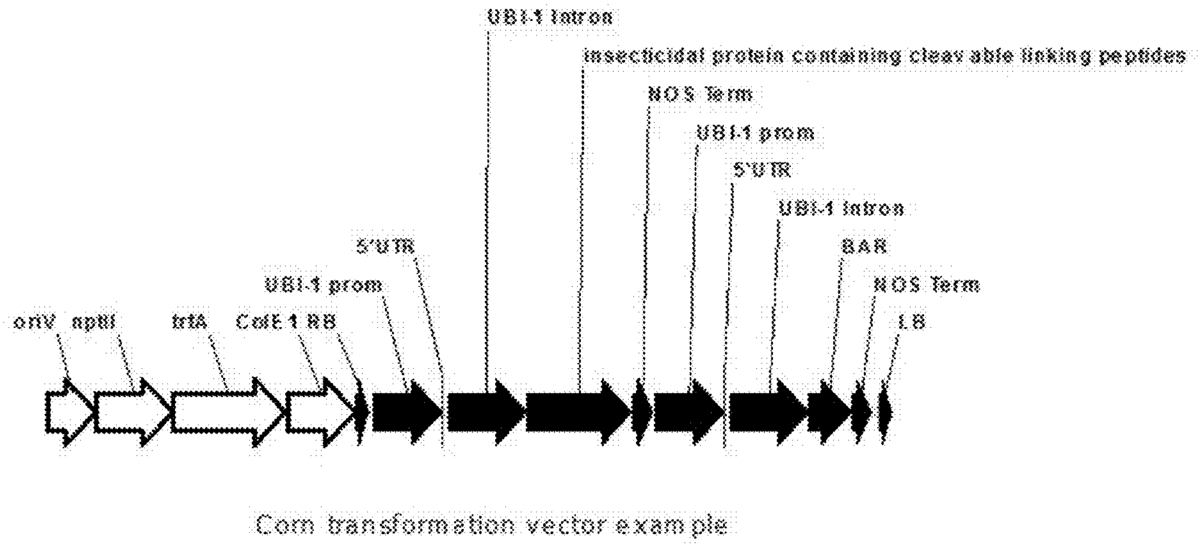
FIG. 8. An example of a stable corn transformation vector. This figure depicts one example of a stable corn transformation vector. The white arrows depict the basic backbone components of the vector. The black arrows depict the T-DNA portion of the vector which is transformed into the corn genome and results in the selection and regeneration of transgenic corn plants expressing the insecticidal protein containing cleavable linking peptides.

The first component is the (standard binary) vector design required for corn transformation, which involves the creation of a vector which has two regions: a backbone (FIG. 8: white arrows) and a t-DNA region (FIG. 8: black arrows). The backbone has two components: an origin of replication (Ori or ori) and a selectable marker. The backbone described in this example has two Oris so it can be replicated in both *E. coli* for subcloning purposes (for example the ColE1 a high copy Ori) and *Agrobacterium* for propagation of the plasmid (for example the OriV a low copy ori and its trfA initiation protein). The backbone described in this example has a bacterial neomycin phosphotransferase II (nptll) gene for resistance to kanamycin. This gene allows the selection for *E. coli* or *Agrobacterium* transformed with the plasmid. The t-DNA region contains three components: borders, an expression cassette for selection of transgenic plant cells on tissue culture media, and an expression cassette for the stable expression of the transgenic promoter. T-DNA borders are repeat sequences (25 bp) that flank the T-DNA in direct orientation and delineate the region that the virulence genes will replicate and package for genetic transformation. In this example the backbone and the T-DNA sequences are published by Coutu et al., in, Transgenic Res (2007) 16:771-781, the disclosure of which is incorporated herein by reference in its entirety. In this example, the expression cassettes for both the selectable marker and the gene of interest (an insecticidal or nematicidal insecticidal and/or nematicidal protein containing binary and tertiary cleavable linking peptides and a TP) are similar in design and differ only in the region encoding the open reading frame (ORF) for their respective proteins.

A good example of this expression cassette is the corn Ubi-1 promoter and expression cassette defined by Christensen and Quail in Transgenic Res. 1996 May; 5(3):213-8, the disclosure of which is incorporated herein by reference in its entirety. The promoter region from a constitutively expressing gene cassette from a plant can be subcloned and the gene removed and replaced by a multicloning site (MC S) to drop in the other genes of interest. In the case of the Ubi-1 example the 906 bp promoter region (UBI-1 prom) promotes the transcription of an 81 bp 5' untranslated region (5'UTR) and a Ubi-1 1025 bp intron (UBI-1 intron) which is followed by a MCS. The cassette is terminated by the insertion of a terminator sequence, in this example the terminator sequence is about 250 bp of nopaline synthase (NOS) 3' untranslated sequence and polyadenylation signals. For the selectable marker cassette, the insertion of a gene which confers plant resistance to an herbicidal chemical can be used such that cells expressing that cassette will be resistant to the inclusion of the herbicidal chemical in the tissue culture media. In this example, the selectable marker gene can be a gene that encodes phosphinothricin acetyltransferase activity (see U.S. Pat. No. 5,648,477, the disclosure of which is incorporated herein by reference in its entirety). The expression of an insecticidal transgenic protein containing binary and tertiary cleavable linking peptide and a TP is exemplified herein, specifically in Example A, where such a gene is transiently expressed in tobacco. The linear composition of the entire labeled exemplary corn transformation vector example can be seen in FIG. 8.

The second component to this example is corn plant transformation by standard binary vectors and subsequence transgenic plant regeneration which is well known in the art, and is defined and documented by Frame et al., Plant Physiology, May 2002, Vol. 129, pp. 13-22 and Vega et al., Plant Cell Rep (2008) 27:297-305, the disclosures of which are incorporated herein by reference in their entireties. Following these protocols will result in the recovery of a transgenic plant with the t-DNA described above.

The third component to this section is the validation of expression of the intact protein. Transgenic plant tissue can be prepared to isolate the total soluble protein and this can be quantified on an iELISA using a primary antibody specifically binds the TP recombinantly generated (as defined in Example A as provided herein). The intact nature of the protein can be validated using a similar total soluble protein isolation followed by a protein gel and western blotting procedures (also as defined and exemplified in Example A herein).

Example 6. Subcloning and Expression of a Bt Cry Insecticidal Protein to Contain Binary and Tertiary Cleavable Linking Peptides In some representative examples, protocols for the expression and synthesis of modified TPs are provided herein. In one example, further detailed below, modified Bt proteins are described that when exposed to the contents of insect and nematode and human gut environments, the Bt protein is more efficiently cleaved by the constituent insect or nematode proteases. The presence of the binary or tertiary cleavable peptide results in a more complete dissociation of the stabilizing or inactive region of the Bt protein resulting in the enhanced production of insecticidal and nematicidal TPs.

This example details how to subclone an exemplary Bt cry TP to contain binary and tertiary cleavable linking peptide (L). There are two steps to this example: The conversion of a Bt cry TP gene sequence to contain the binary or tertiary cleavable linking peptide (L) between a non-insecticidal domain ($Bt_{inactive}$) and an insecticidal domain ($Bt_{active}$) gene, and the creation of a plant expressing that gene.

The simplest method to insert a binary or tertiary cleavable peptide (L) into a cry gene is to order the synthesis of the DNA encoding the entire gene with the inserted sequence.

The Bt cry TP gene can be any number of genes; a good example of a Bt TP gene is the Cry3a gene. A variant of Cry3a gene can be found in Genbank as accession no. AX712174: Sequence 8 from Patent WO03018810, (accessible at blast.ncbi.nlm.nih.gov/Blast.cgi?PROGRAM=blastn&PAGE_TYPE=BlastSearch&LINK_LOC=blasthome) which is incorporated herein by reference in its entirety. This sequence is derived from a publication Walters et al., Appl. Environ. Microbiol. January 2008 vol. 74 no. 2 367-374, the disclosure of which is incorporated herein by reference in its entirety. In this publication, the authors replace a "VSS" wild-type three amino acid sequence with a "AAPF" four amino acid sequence in the domain I loop between alpha-helix 3 and alpha-helix 4, to increase the cleavage of the non-active 12 kDa domain I from the insecticidal or active 55 kDa remainder. The authors hypothesize this AAPF is recognized by the Chymotrypsin/Cathepsin G enzyme in gut of *Diabrotica* and leads to more rapid conversation of the full length 67 kDa protein to a cleavage and the 55 kDa form which is the insecticidal mature protein and exhibits specific binding to western corn rootworm brush border membrane compared to the 67 kDa form. This AAPF amino acid sequence was analyzed via FRET and yeast-produced dimers of the TP "U+2-ACTX-Hv1a" separated by AAPF amino acids in our hands and neither FRET nor protein showed any cleavability by human gastrointestinal proteases (data not shown). Thus, the peptide amino acid sequence AAPF used in the Walters et al. reference cited above is not a binary or tertiary cleavable linking peptide as described herein.

For the example of converting the Cry3a gene into one with an intervening binary or tertiary cleavable linking peptide, the cloning of the DNA sequence described in Walters et al. is performed such that the base pairs encoding the AAPF amino acids are removed and in their place (in frame) are the codons encoding the amino acids for a binary cleavable linking peptide ALKLFV (SEQ ID NO: 1605) or the tertiary cleavable linking peptide ALKLFVGS (SEQ ID NO: 1660). This would insert the cleavable binary or tertiary peptide between the propeptide ($Bt_{inactive}$) and the Bt active toxin ($Bt_{active}$) as illustrated in FIG. 3B where the cleavable binary or tertiary peptide is placed in frame between the inactive portion of the Bt TP ($Bt_{inactive}$) and the active portion of the Bt $TP_{active}$).

For the expression of a Bt Cry TP to contain a binary and/or a tertiary cleavable linking peptide, the DNA described above would be subcloned into the multi-cloning site within the insecticidal gene expression cassette, and transformed in corn as previously described by Example B.

Example 7. Exemplary Binary Peptides

In some embodiments, the binary peptide of the present invention is the binary peptide that has an amino acid sequence that can be assembled by combining a sequence from the SGF screening Y set and the insect cleavability X set, in X-Y or Y-X orientation from the X sequences and Y sequences.

One embodiment of the sequences discovered from SGF screening, Y, are: AFF, AFG, AFI, AFL, AFV, AFY, AGF, AGL, AIF, AIL, ALF, ALG, ALI, ALL, ALY, AYF, AYL, DFF, DFG, DFI, DFL, DFY, DGF, DGL, DIF, DLF, DLG, DLY, DYF, DYL, EFF, EFG, EFI, EFL, EFY, EGF, EGL, EIF, ELF, ELG, ELY, EYF, EYL, FF, FFA, FFD, FFE, FFF, FFG, FFI, FFK, FFL, FFR, FFS, FFT, FFV, FFY, FGA, FGD, FGE, FGF, FGI, FGK, FGL, FGR, FGS, FGT, FGV, FGY, FLV, FLR, FYA, FYD, FYE, FYF, FYG, FYI, FYK, FYL, FYR, FYS, FYT, FYV, FYY, GFA, GFD, GFE, GFF, GFI, GFK, GFL, GFR, GFS, GFT, GFV, GFY, GGL, GIF, GIL, GLF, GLI, GLL, GLY, GYF, GYL, IF, IFA, IFF, IFG, IFI, IFL, IFV, IFY, IGF, IGL, IIF, IIL, ILF, ILG, ILI, ILL, ILY, IYF, IYL, LFA, LFF, LFG, LFI, LFL, LFV, LFY, LG, LGA, LGE, LGF, LGI, LGL, LGV, LGY, LIF, LIG, LII, LIL, LIY, LLF, LLG, LLI, LLL, LLY, LYA, LYF, LYG, LYI, LYL, LYV, LYY, NFF, NFG, NFI, NFL, NFY, NGF, NGL, NIL, NLG, NLI, NLL, NYF, NYL, QFF, QFG, QFI, QFL, QFY, QGF, QGL, QIL, QLG, QLI, QLL, QYF, QYL, SFF, SFG, SFI, SFL, SFY, SGF, SGL, SIF, SIL, SLF, SLG, SLI, SLL, SLY, SYF, SYL, TFF, TFG, TFI, TFL, TFY, TGF, TGL, TIF, TIL, TLF, TLG, TLI, TLL, TLY, TYF, TYL, VFF, VFG, VFI, VFL, VFY, VGF, VGL, VIF, VIL, VLF, VLG, VLI, VLL, VLY, VYF, VYL, YFA, YFD, YFE, YFF, YFG, YFI, YFK, YFL, YFR, YFS, YFT, YFV, YFY, YGF, YGL, YYF, YYL.

Another embodiment of the sequences discovered from SGF screening, Y, are: AFF, AFI, AFL, AFY, AIF, AIL, ALF, ALI, ALL, ALY, AYF, AYL, DFF, DFI, DFL, DFY, DIF, DLF, DLY, DYF, DYL, YFL, EFF, EFI, EFL, 0, EFY, EIF, ELF, ELY, EYF, EYL, FFA, FFD, FFE, FFF, FFI, FFK, FFL, FFR, FFS, FFT, FFV, FFY, FYA, FYD, FYE, FYF, FYI, FYK, FYL, FYR, FYS, FYT, FYV, FYY, IFA, IFF, IFI, IFL, IFV, IFY, IIF, IIL, ILF, ILI, ILL, ILY, IYF, IYL, LFA, LFF, LFI, LFL, LFV, LFY, LIF, LII, LIL, LIY, LLF, LLI, LLL, LLY, LYA, LYF, LYI, LYL, LYV, LYY, NFF, NFI, NFL, NFY, NIL, NLI, NLL, NYF, NYL, QFF, QFI, QFL, QFY, QIL, QLI, QLL, QYF, QYL, SFF, SFI, SFL, SFY, SIF, SIL, SLF, SLI, SLL, SLY, SYF, SYL, TFF, TFI, TFL, TFY, TIF, TIL, TLF, TLI, TLL, TLY, TYF, TYL, VFF, VFI, VFL, VFY, VIF, VIL, VLF, VLI, VLL, VLY, VYF, VYL, YFA, YFD, YFE, YFF, YFI, YFK, YFL, YFR, YFS, YFT, YFV, YFY, YYF, YYL.

One embodiment of the sequences discovered from insect cleavability, X, are: AAG, AAK, AAR, AFG, AFK, AFR, AGF, AGI, AGK, AGL, AGN, AGQ, AGR, AGS, AGT, AGY, AIG, AIK, AIN, AIQ, AIR, AKF, AKG, AKI, AKK, AKL, AKN, AKQ, AKR, AKS, AKT, AKY, ALG, ALK, ALN, ALQ, ALR, APF, APG, APK, APR, ARF, ARG, ARI, ARK, ARL, ARN, ARQ, ARR, ARS, ART, ARY, ASG, ASK, ASR, ATG, ATK, ATR, AVG, AVK, AVR, AYG, AYK, AYR, DGK, DGR, DIG, DIK, DIR, DLG, DLK, DLR, EGK, EGR, EIG, EIK, EIR, ELG, ELK, ELR, ER, FVR, GAF, GAI, GAK, GAL, GAR, GAY, GFK, GFR, GIK, GIN, GIQ, GIR, GKA, GKD, GKE, GKF, GKI, GKK, GKL, GKN, GKQ, GKR, GKS, GKT, GKV, GKY, GLK, GLN, GLQ, GLR, GNA, GNK, GNR, GNV, GPK, GPR, GQA, GQK, GQR, GQV, GRA, GRD, GRE, GRF, GRI, GRK, GRL, GRN, GRQ, GRR, GRS, GRT, GRV, GRY, GSI, GSK, GSL, GSR, GTI, GTK, GTL, GTR, GVF, GVI, GVK, GVL, GVR, GVY, GYK, GYR, IGA, IGF, IGI, IGK, IGL, IGN, IGQ, IGR, IGS, IGT, IGV, IGY, IIG, IIK, IIR, IKA, IKF, IKG, IKI, IKK, IKL, IKN, IKQ, IKR, IKS, IKT, IKV, IKY, ILG, ILK, ILR, INA, ING, INK, INR, INV, IPG, IPK, IPR, IQA, IQG, IQK, IQR, IQV, IRA, IRF, IRG, IRI, IRK, IRL, IRN, IRQ, IRR, IRS, IRT, IRV, IRY, ISG, ISK, ISR, ITG, ITK, ITR, KAF, KAG, KAI, KAK, KAL, KAR, KAY, KFF, KFG, KFK, KFR, KGA, KGD, KGE, KGF, KGI, KGK, KGL, KGN, KGQ, KGR, KGS, KGT, KGV, KGY, KIG, KIK, KIN, KIQ, KIR, KKA, KKD, KKE, KKF, KKG, KKN, KKQ, KKS, KKT, KKV, KKY, KLG, KLK, KLN, KLQ, KLR, KNG, KNK, KNR, KPG, KPK, KPR, KQG, KQK, KQR, KRA, KRD, KRE, KRF, KRG, KRN, KRQ, KRS, KRT, KRV, KRY, KSG, KSI, KSK, KSL, KSR, KTG, KTI, KTK, KTL, KTR, KVF, KVG, KVI, KVK, KVL, KVR, KVY, KYG, KYK, KYR, LFR, LGA, LGF, LGI, LGK, LGL, LGN, LGQ, LGR, LGS, LGT, LGV, LGY, LIG, LIK, LIR, LK, LKA, LKF, LKG, LKI, LKK, LKL, LKN, LKQ, LKR, LKS, LKT, LKV, LKY, LLG, LLK, LLR, LNA, LNG, LNK, LNR, LNV, LPG, LPK, LPR, LQA, LQG, LQK, LQR, LQV, LRA, LRF, LRG, LRI, LRK, LRL, LRN, LRQ, LRR, LRS, LRT, LRV, LRY, LSG, LSK, LSR, LTG, LTK, LTR, NGK, NGR, NIG, NIK, NIR, NLG, NLK, NLR, PGK, PGR, PIG, PIK, PIR, PKG, PKK, PKR, PLG, PLK, PLR, PRG, PRK, PRR, QGK, QGR, QIG, QIK, QIR, QLG, QLK, QLR, RAF, RAG, RAI, RAK, RAL, RAR, RAY, RFF, RFG, RFK, RFR, RGA, RGD, RGE, RGF, RGI, RGK, RGL, RGN, RGQ, RGR, RGS, RGT, RGV, RGY, RIG, RIK, RIN, RIQ, RIR, RKA, RKD, RKE, RKF, RKG, RKK, RKN, RKQ, RKS, RKT, RKV, RKY, RLF, RLFL, RLG, RLK, RLN, RLQ, RLR, RNG, RNK, RNR, RPG, RPK, RPR, RQG, RQK, RQR, RRA, RRD, RRE, RRF, RRG, RRK, RRN, RRQ, RRR, RRS, RRT, RRV, RRY, RSG, RSI, RSK, RSL, RSR, RTG, RTI, RTK, RTL, RTR, RVF, RVG, RVI, RVK, RVL, RVR, RVY, RYG, RYK, RYR, VAG, VAK, VAR, VFG, VFK, VFR, VGF, VGI, VGK, VGL, VGN, VGQ, VGR, VGS, VGT, VGY, VIG, VIK, VIN, VIQ, VIR, VKF, VKG, VKI, VKK, VKL, VKN, VKQ, VKR, VKS, VKT, VKY, VLG, VLK, VLN, VLQ, VLR, VPG, VPK, VPR, VR, VRF, VRG, VRI, VRK, VRL, VRN, VRQ, VRR, VRS, VRT, VRY, VSG, VSK, VSR, VTG, VTK, VTR, VVG, VVK, VVR, VYG, VYK, VYR.

Another embodiment of the sequences discovered from insect cleavability, X, are: AAK, AAR, AFK, AFR, AIK, AIN, AIQ, AIR, AKF, AKI, AKK, AKL, AKN, AKQ, AKR, AKS, AKT, AKY, ALK, ALN, ALQ, ALR, APK, APR, ARF, ARI, ARK, ARL, ARN, ARQ, ARR, ARS, ART, ARY, ASK, ASR, ATK, ATR, AVK, AVR, AYK, AYR, DIK, DIR, DLK, DLR, EIK, EIR, ELK, ELR, IIK, IIR, IKA, IKF, IKI, IKK, IKL, IKN, IKQ, IKR, IKS, IKT, IKV, IKY, ILK, ILR, INA, INK, INR, INV, IPK, IPR, IQA, IQK, IQR, IQV, IRA, IRF, IRI, IRK, IRL, IRN, IRQ, IRR, IRS, IRT, IRV, IRY, ISK, ISR, ITK, ITR, KAF, KAI, KAK, KAL, KAR, KAY, KFK, KFR, KIK, KIN, KIQ, KIR, KKA, KKD, KKE, KKF, KKN, KKQ, KKS, KKT, KKV, KKY, KLK, KLN, KLQ, KLR, KNK, KNR, KPK, KPR, KQK, KQR, KRA, KRD, KRE, KRF, KRN, KRQ, KRS, KRT, KRV, KRY, KSI, KSK, KSL, KSR, KTI, KTK, KTL, KTR, KVF, KVI, KVK, KVL, KVR, KVY, KYK, KYR, LIK, LIR, LKA, LKF, LKI, LKK, LKL, LKN, LKQ, LKR, LKS, LKT, LKV, LKY, LLK, LLR, LNA, LNK, LNR, LNV, LPK, LPR, LQA, LQK, LQR, LQV, LRA, LRF, LRI, LRK, LRL, LRN, LRQ, LRR, LRS, LRT, LRV, LRY, LSK, LSR, LTK, LTR, NIK, NIR, NLK, NLR, PIK, PIR, PKK, PKR, PLK, PLR, PRK, PRR, QIK, QIR, QLK, QLR, RAF, RAI, RAK, RAL, RAR, RAY, RFK, RFR, RIK, RIN, RIQ, RIR, RKA, RKD, RKE, RKF, RKN, RKQ, RKS, RKT, RKV, RKY, RLK, RLN, RLQ, RLR, RNK, RNR, RPK, RPR, RQK, RQR, RRA, RRD, RRE, RRF, RRN, RRQ, RRS, RRT, RRV, RRY, RSI, RSK, RSL, RSR, RTI, RTK, RTL, RTR, RVF, RVI, RVK, RVL, RVR, RVY, RYK, RYR, VAK, VAR, VFK, VFR, VIK, VIN, VIQ, VIR, VKF, VKI, VKK, VKL, VKN, VKQ, VKR, VKS, VKT, VKY, VLK, VLN, VLQ, VLR, VPK, VPR, VRF, VRI, VRK, VRL, VRN, VRQ, VRR, VRS, VRT, VRY, VSK, VSR, VTK, VTR, VVK, VVR, VYK, VYR.

Figure 9:
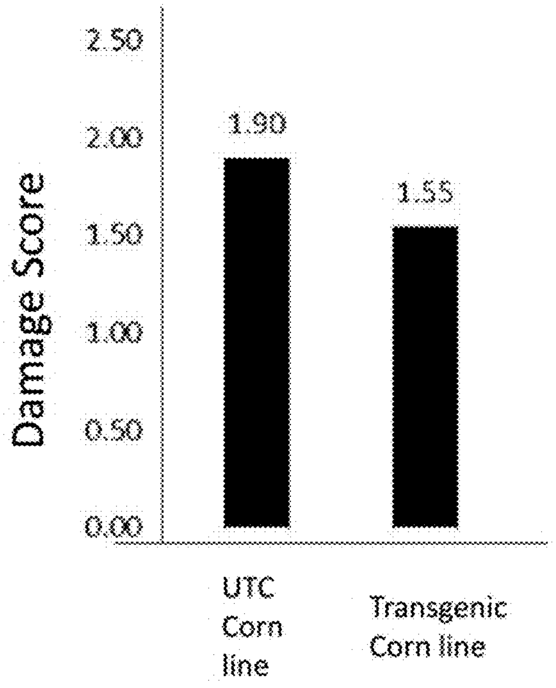
FIG. 9. An example of efficacy data of a field trial of corn plants expressing the open reading frame (ORF) comprising an exemplary insecticidal and/or nematicidal protein as described in FIG. 6A after transformation by a vector described in FIG. 8.

Example 8. The Insecticidal Efficacy of a Transgenic Plant Expressing the Insecticidal and/or Nematicidal Proteins of the Present Invention Transgenic corn plants were made using the vector described in FIG. 8. The ORF comprising the components STA, L, and TP was defined by FIG. 6B and prepared as a polynucleotide operable for transformation into corn plant cells. A field trial was performed by planting seeds at 6 inch spacing, with 125 seeds per row with 6 reps. The UTC corn line was the parent line used as an explant for corn transformation and the transgenic corn line was the resulting transgenic plant expressing the transgene of FIG. 6B. Each plant was infested with 600 western corn rootworm eggs and then scored once the crop reached maturity. Scoring was performed on a 0-3 scale where the three whorls of roots underground were scored for damage using (Oleson, J. D., Y. Park, T. M. Nowatzki, and J. J. Tollefson. 2005. J. Econ Entomol. 98(1):1-8). A 0 score represents no damage. A 3 score represents that all 3 root whorls were destroyed. The Field trial data of non-transgenic and transgenic corn plants where transgenic plants displayed reduced damage by western corn rootworm shown in FIG. 9 is the average score of 30 plants, 5 from each of the 6 reps picked at random. The transgenic plant comprising the insecticidal and/or nematicidal protein shown in FIG. 6B turned in a score of 1.55 damage compared to the 1.90 damage in the untransformed corn line that was used as an explant to generate the transgenic corn line. The use of the insecticidal and/or nematicidal protein shown in FIG. 6B when transformed into corn demonstrates the efficacy of the transgene in controlling a pest of corn, western corn rootworm.

---

SEQUENCE LISTING (1775 sequences)

SEQ ID NO: 1 - protein, 4 aa, Pisum sativum
IGER

SEQ ID NO: 2 - protein, 5 aa, Nicotiana attenuata
EEKKN

SEQ ID NO: 3 - protein, 8 aa, Nicotiana tabacum
ETMFKHGL

SEQ ID NO: 4 - protein, 24 aa, Hordeum vulgare
MANKHLSLSLFLVLLGLSASLASG

SEQ ID NO: 5 - protein, 41 aa, Hadronyche versuta
GSQYCVPVDQPCSLNTQPCCDDATCTQERNENGHTVYYCRA

SEQ ID NO: 6 - protein, 39 aa, Hadronyche versuta
QYCVPVDQPCSLNTQPCCDDATCTQERNENGHTVYYCRA

SEQ ID NO: 7 - protein, 238 aa, Aequorea victoria
ASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 8 - protein, 38 aa, Hadronyche versuta
MSPTCIPSGQPCPYNENCCSQSCTFKENENGNTVKRCD

SEQ ID NO: 9 - protein, 61 aa, Hadronyche versuta
MANKHLSLSLFLVLLGLSASLASGSPTCIPSGQPCPYNENCCSQSCTFKENENGNTVKRCD

SEQ ID NO: 10 - protein, 282 aa, Hadronyche versuta
MASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKIGERQYCVPVDQPCSLNTQPCCDDATCTQERNENGHTVYYCRA

SEQ ID NO: 11 - protein, 305 aa, Hadronyche versuta
MANKHLSLSLFLVLLGLSASLASGASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYKIGERQYCVPVDQPCSLNTQPCCDDATCTQERNENGHTVYYCRA

SEQ ID NO: 12 - protein, 39 aa, Hadronyche versuta; identical to SEQ ID NO: 6

SEQ ID NO: 13 - protein, 239 aa, Aequorea victoria
MASKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 14 - DNA, 932 bp, Agrobacterium tumefaciens
ttaattaaatggctaataaacacctgagtttgtcactattcctcgtgttgctcgggttatctgcttcacttgcaagcggagctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaacctagg

SEQ ID NO: 15 - DNA, 849 bp, Nicotiana benthamiana
atggctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaa

SEQ ID NO: 16 - protein, 4 aa, Nicotiana benthamiana
KDEL

SEQ ID NO: 17 - DNA, 930 bp, Nicotiana benthamiana
atggctaataaacacctgagtttgtcactattcctcgtgttgctcgggttatctgcttcacttgcaagcggagctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctattaatactcaaccatgttgtgatgatgctacttgtactcaagaaagaaatgaaaatggacatactgtttattattgtagagctaaagatgagctctaa

SEQ ID NO: 18 - protein, 26 aa, Nicotiana benthamiana
MGKMASLFASLLVVLVSLSLASESSA

SEQ ID NO: 19 - protein, 26 aa, Nicotiana benthamiana
MGKMASLFATFLVVLVSLSLASESSA

SEQ ID NO: 20 - DNA, 78 bp, Nicotiana benthamiana
atgggtaagatggcttctctgtttgcttctctgctggttgttctggtttctctgtctctggcttctgaatcttctgct

SEQ ID NO: 21 - DNA, 938 bp, Nicotiana benthamiana
ttaattaaatgggtaagatggcttctctgtttgcttctctgctggttgttctggtttctctgtctctggcttctgaatcttctgctgctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaacctagg

SEQ ID NO: 22 - DNA, 78 bp, Nicotiana benthamiana
atgggtaagatggcttctctgtttgctacttttctggttgttctggtttctctgtctctggcttctgaatcttctgct

SEQ ID NO: 23 - DNA, 938 bp, Nicotiana benthamiana
ttaattaaatgggtaagatggcttctctgtttgctacttttctggttgttctggtttctctgtctctggcttctgaatcttctgctgctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaaattggtgaaagacaatattgtgttccagttgatcaaccatgttctcttaatactcaaccatgttgtgatgatgctacttgtactcaagaaagaaatgaaaatggacatactgtttattattgtagagcttaacctagg

SEQ ID NO: 24 - protein, 37 aa, Hadronyche versuta
SPTCIPSGQPCPYNENCCSQSCTFKENENGNTVKRCD

SEQ ID NO: 25 - protein, 224 aa, Juniperus ashei
MARVSELAFLLAATLAISLHMQEAGVVKFDIKNQCGYTVWAAGLPGGGKRLDQGQTWTVNLAAGTASARFWGRTGCTFDASGKGSCQTGDCGGQLSCTVSGAVPATLAEYTQSDQDYYDVSLVDGFNIPLAINPTNAQCTAPACKADINAVCPSELKVDGGCNSACNVFKTDQYCCRNAYVDNCPATNYSKIFKNQCPQAYSYAKDDTATFACASGTDYSIVFC

SEQ ID NO: 26 - protein, 197 aa, Juniperus ashei
KFDIKNQCGYTVWAAGLPGGGKRLDQGQTWTVNLAAGTASARFWGRTGCTFDASGKGSCQTGDCGGQLSCTVSGAVPATLAEYTQSDQDYYDVSLVDGFNIPLAINPTNAQCTAPACKADINAVCPSELKVDGGCNSACNVFKTDQYCCRNAYVDNCPATNYSKIFKNQCPQAYSYAKDDTATFACASGTDYSIVFC

SEQ ID NO: 27 - protein, 27 aa, Juniperus ashei
MARVSELAFLLAATLAISLHMQEAGVV

SEQ ID NO: 28 - protein, 105 aa, Galanthus nivalis
DNILYSGETLSTGEFLNYGSFVFIMQEDCNLVLYDVDKPIWATNTGGLSRSCFLSMQTDGNLVVYNPSNKPIWASNTGGQNGNYVCILQKDRNVVIYGTDRWATG

SEQ ID NO: 29 - protein, 29 aa, Kluyveromyces lactis
GSRSCCPCYWGGCPWGQNCYPEGCSGPKV

SEQ ID NO: 30 - protein, 27 aa, Kluyveromyces lactis
RSCCPCYWGGCPWGQNCYPEGCSGPKV

SEQ ID NO: 31 - DNA, 366 bp, Hordeum Vulgare
aagcttgaaaaaaatgaaattttccactattttagcagcatctacagctttaatcagtgttgtcatggctgcacctgtgagtaccgaaacagatatagacgaccttccaatctctgttccagaagaggctttgataggattcatcgatttgactggtgatgaagtttcattgttaccagtgaataatggtacccatactggtattttgttcctaaacaccacaattgctgaagctgcttttgcagataaggatgatttggagaaaagaggttctagatcatgctgcccttgttactggggtggttgtccatggggacaaaactgttatcctgaaggatgttctggtccaaaggtatgagcggccgc

SEQ ID NO: 32 - DNA, 360 bp, Anemonia Viridis
aagcttgaaaaaaatgaaattttccacaatcttagctgcaagtactgctcttatttctgttgtgatggctgctccagtatctaccgaaacagatatcgatgatttgccaatttcagtccctgaagaggcactaatcggattcattgacttaaccggtgatgaagtgagtttgttgccagttaacaacggtactcatacaggtatattgtttttgaataccactatagctgaagcagcattcgctgataaagatgacttagaaaagagaagatcatgctgcccttgttactggggtggttgtccatggggtcaaaattgttatccagagggttgttctggacctaaggtttgagcggccgc

SEQ ID NO: 33 - protein, 675 aa, Bacillus thuringiensis israelensis
MNPYQNKNEYEIFNAPSNGFSKSNNYSRYPLANKPNQPLKNTNYKDWLNVCQDNQQYGNNAGNFASSETIVGVSAGIIVVGTMLGAFAAPVLAAGIISFGTLLPIFWQGSDPANVWQDLLNIGGRPIQEIDKNIINVLTSIVTPIKNQLDKYQEFFDKWEPARTHANAKAVHDLFTTLEPIIDKDLDMLKNNASYRIPTLPAYAQIATWHLNLLKHAATYYNIWLQNQGINPSTFNSSNYYQGYLKRKIQEYTDYCIQTYNAGLTMIRTNTNATWNMYNTYRLEMTLTVLDLIAIFPNYDPEKYPIGVKSELIREVYTNVNSDTFRTITELENGLTRNPTLFTWINQGRFYTRNSRDILDPYDIFSFTGNQMAFTHTNDDRNIIWGAVHGNIISQDTSKVFPFYRNKPIDKVEIVRHREYSDIIYEMIFFSNSSEVFRYSSNSTIENNYKRTDSYMIPKQTWKNEEYGHTLSYIKTDNYIFSVVRERRRVAFSWTHTSVDFQNTIDLDNITQIHALKALKVSSDSKIVKGPGHTGGDLVILKDSMDFRVRFLKNVSRQYQVRIRYATNAPKTTVFLTGIDTISVELPSTTSRQNPNATDLTYADFGYVTFPRTVPNKTFEGEDTLLMTLYGTPNHSYNIYIDKIEFIPITQSVLDYTEKQNIEKTQKIVNDLFVN

SEQ ID NO: 34 - protein, 675 aa, Bacillus thuringiensis israelensis
MNPYQNKNEYEIFNAPSNGFSKSNNYSRYPLANKPNQPLKNTNYKDWLNVCQDNQQYGNNAGNFASSETIVGVSAGIIVVGTMLGAFAAPVLAAGIISFGTLLPIFWQGSDPANVWQDLLNIGGRPIQEIDKNIINVLTSIVTPIKNQLDKYQEFFDKWEPARTHANAKAVHDLFTTLEPIIDKDLDMLKNNASYRIPTLPAYAQIATWHLNLLKHAATYYNIWLQNQGINPSTFNSSNYYQGYLKRKIQEYTDYCIQTYNAGLTMIRTNTNATWNMYNTYRLEMTLTVLDLIAIFPNYDPEKYPIGVKSELIREVYTNVNSDTFRTITELENGLTRNPTLFTWINQGRFYTRNSRDILDPYDIFSFTGNQMAFTHTNDDRNIIWGAVHGNIISQDTSKVFPFYRNKPIDKVEIVRHREYSDIIYEMIFFSNSSEVFRYSSNSTIENNYKRTDSYMIPKQTWKNKEYGHTLSYIKTDNYIFSVVRERRRVAFSWTHTSVDFQNTIDLDNITQIHALKALKVSSDSKIVKGPGHTGGDLVILKDSMDFRVRFLKNVSRQYQVRIRYATNAPKTTVFLTGIDTISVELPSTTSRQNPNATDLTYADFGYVTFPRTVPNKTFEGEDTLLMTLYGTPNHSYNIYIDKIEFIPITQSVLDYTEKQNIEKTQKIVNDLFVN

SEQ ID NO: 35 - protein, 675 aa, Bacillus thuringiensis s. israelensis BRC-LLP29; identical to SEQ ID NO: 34

SEQ ID NO: 36 - protein, 643 aa, Bacillus thuringiensis israelensis
MEDSSLDTLSIVNETDFPLYNNYTEPTIAPALIAVAPIAQYLATAIGKWAAKAAFSKVLSLIFPGSQPATMEKVRTEVETLINQKLSQDRVNILNAEYRGIIEVSDVFDAYIKQPGFTPATAKGYFLNLSGAIIQRLPQFEVQTYEGVSIALFTQMCTLHLTLLKDGILAGSAWGFTQADVDSFIKLFNQKVLDYRTRLMRMYTEEFGRLCKVSLKDGLTFRNMCNLYVFPFAEAWSLMRYEGLKLQSSLSLWDYVGVSIPVNYNEWGGLVYKLLMGEVNQRLTTVKFNYSFTNEPADIPARENIRGVHPIYDPSSGLTGWIGNGRTNNFNFADNNGNEIMEVRTQTFYQNPNNEPIAPRDIINQILTAPAPADLFFKNADINVKFTQWFQSTLYGWNIKLGTQTVLSSRTGTIPPNYLAYDGYYIRAISACPRGVSLAYNHDLTTLTYNRIEYDSPTTENIIVGFAPDNTKDFYSKKSHYLSETNDSYVIPALQFAEVSDRSFLEDTPDQATDGSIKFARTFISNEAKYSIRLNTGFNTATRYKLIIRVRVPYRLPAGIRVQSQNSGNNRMLGSFTANANPEWVDFVTDAFTFNDLGITTSSTNALFSISSDSLNSGEEWYLSQLFLVKESAFTTQINPLLK

SEQ ID NO: 37 - protein, 78 aa, Bacillus thuringiensis israelensis
NSGNNRMLGSFTANANPEWVDFVTDAFTFNDLGITTSSTNALFSISSDSLNSGEEWYLSQLFLVKESAFTTQINPLLK

SEQ ID NO: 38 - protein, 643 aa, Bacillus thuringiensis israelensis; identical to SEQ ID NO: 36

SEQ ID NO: 39 - protein, 643 aa, Bacillus thuringiensis s. israelensis BRC-LLP29
MNYMEDSSLDTLSIVNETDFPLYNNYTEPTIAPALIAVAPIAQYLATAIGKWAAKAAFSKVLSLIFPGSQPATMEKVRTEVETLINQKLSQDRVNILNAEYRGIIEVSDVFDAYIKQPGFTPATAKGYFLNLSGAIIQRLPQFEVQTYEGVSIALFTQMCTLHLTLLKDGILAGSAWGFTQADVDSFIKLFNQKVLDYRTRLMRMYTEEFGRLCKVSLKDGLTFRNMCNLYVFPFAEAWSLMRYEGLKLQSSLSLWDYVGVSIPVNYNEWGGLVYKLLMGEVNQRLTTVKFNYSFTNEPADIPARENIRGVHPIYDPSSGLTGWIGNGRTNNFNFADNNGNEIMEVRTQTFYQNPNNEPIAPRDIINQILTAPAPADLFFKNADINVKFTQWFQSTLYGWNIKLGTQTVLSSRTGTIPPNYLAYDGYYIRAISACPRGVSLAYNHDLTTLTYNRIEYDSPTTENIIVGFAPDNTKDFYSKKSHYLSETNDSYVIPALQFAEVSDRSFLEDTPDQATDGSIKFARTFISNEAKYSIRLNTGFNTATRYKLIIRVRVPYRLPAGIRVQSQNSGNNRMLGSFTANANPEWVDFVTDAFTFNDLGITTSSTNALFSISSDSLNSGEEWYLSQLFLVKESAFTTQINP

SEQ ID NO: 40 - protein, 724 aa, Bacillus thuringiensis jegathesan 367
MQNNNFNTTEINNMINFPMYNGRLEPSLAPALIAVAPIAKYLATALAKWAVKQGFAKLKSEIFPGNTPATMDKVRIEVQTLLDQRLQDDRVKILEGEYKGIIDVSKVFTDYVNQSKFETGTANRLFFDTSNQLISRLPQFEIAGYEGVSISLFTQMCTFHLGLLKDGILAGSDWGFAPADKDALICQFNRFVNEYNTRLMVLYSKEFGRLLAKNLNEALNFRNMCSLYVFPFSEAWSLLRYEGTKLENTLSLWNFVGESINNISPNDWKGALYKLLMGAPNQRLNNVKFNYSYFSDTQATIHRENIHGVLPTYNGGPTITGWIGNGRFSGLSFPCSNELEITKIKQEITYNDKGGNFNSIVPAATRNEILTATVPTSADPFFKTADINWKYFSPGLYSGWNIKFDDTVTLKSRVPSIIPSNILKYDDYYIRAVSACPKGVSLAYNHDFLTLTYNKLEYDAPTTQNIIVGFSPDNTKSFYRSNSHYLSTTDDAYVIPALQFSTVSDRSFLEDTPDQATDGSIKFTDTVLGNEAKYSIRLNTGFNTATRYRLIIRFKAPARLAAGIRVRSQNSGNNKLLGGIPVEGNSGWIDYITDSFTFDDLGITTSSTNAFFSIDSDGVNASQQWYLSKLILVKESSFTTQIPLKPYVIVRCPDTFFVSNNSSSTYEQGYNNNYNQNSSSMYDQGYNNSYNPNSGCTCNQDYNNSYNQNSGCTCNQGYNNNYPK

SEQ ID NO: 41 - protein, 750 aa, Bacillus thuringiensis medellin
MENNSFNVLANNNMSSFPLFNSKIEPSIAPALIAVAPIAKYLATALAKWALKQGFAKLKSEIFPGNETATMEKVRLEVQTILNQTLQTDRVATLKAEYEGFIHLGKVFTDYVSQSTFTPATAKTHFLNMSNLLIQRLPQFEIAGYEGVSISLFTQMCTLHLGLLKDGILAGSDWGFTPEDKDSLICQFNRYVNEYNTRMMGLYSIEFGRLLAKNLNEALNFRNMCSLYVFPFSEAWYLLRYEGTKLENTLSLWNFVGEDIGGILHNDWKGALYKLLMGATNQRLANVRFNYSYFSDTQGTIHRENILGAHPTYNGEQTPTGWIGNGRLGRFSAPYSNELEITKVEQEITYNNKGDHSNSIVPANTRNEILTATVPITADPFFKTADINWRYFSQGLYYGWNIKFDDRVILNSRVPGGIPSNRLEYDGYYIRAVSACPRNVPLSYNHNYLTLTYNRLEYDAPTTQNIIVGFSPNNTKSFYARNSHYLSATNDAYVIPALQFATVSDRSFLEDTPDQATDGSIKFTETVLGNEAKYSIRLNTGFNTATRYRLVIRFKATARLAAGIRVRSQNSGNNRLLGGIPVEGNSGWVDYITDSFTFNDLGITTASTNAFFSIDSDGVNASQQWYLSKLILVKDFVNNSGFRNQVPLAPYVIARCPNTFFVSNNTSSGYEQGYNDNYNQNTSSGYEQGYNDNYNQNTSSGYEQGYNDNYNQNTSSGYEQGYNDNYNQNTSSGYEQGYNDNYNQNTSSGV

SEQ ID NO: 42 - protein, 792 aa, Bacillus thuringiensis K34
MENNSFNVLANNNMSSFPLFNSKIEPSIAPALIAVAPIAKYLATALAKWALKQGFAKLKSEIFPGNTPATMEKVRLEVQTLLNQTLQADRVAILNAEYQGFINLGKIFTDYVSQSTFTPATAKTHFLSMSNQLIQRLPQFEIAGYEGVSISLFTQMCTLHLGLLKDGILAGSDWGFTPEDKDSLICQFNRYVNEYNTRMMGLYSIEFGRLLAKNLNEALNFRNMCSLYVFPFSEAWYLLRYEGTKLENTLSLWNFVGEDIGGILHNDWKGALYKLLMGATNQRLANVRFNYSYFSDTQGTIHRENILGAHPTYNGEQTPTGWIGNGRLGRFSAPYSNELEITKVEQEITYNNKGDHSNSIVPANTRNEILTATVPITADPFFKTADINWRYFSQGLYYGWNIKFDDKVILNSRVPGGIPSNRLEYDGYYIRAVSACPRNVPLSYNHNYLTLTYNRLEYDAPTTQNIIVGFSPNNTKSFYARNSHYLSATDDAYVIPALQFATVSDRSFLEDTPDQATDGSIKFTETVLGNEAKYSIRLNTGFNTATRYRLVIRFKAPARLAAGIRVRSQNSGNNRLLGGIPVEGNSGWVDYITDSFTFNDLGITTASTNAFFSIDSDGVNASQQWYLSKLILVKDFVNNSGFRNQVPLAPYVITRCPNTFFVSNNTSSGYEQGYNDNYNQNTSSGYEQGYNDNYNQNTSSGYEQGYNDNYNQNTSSGYEQGYNDNYNQNTSSEYEQGYNDNYNQNTSSGYEQGYNDNYNQNTSSGYEQGYIDNYRPNTECKCGRRHNNYDHK

SEQ ID NO: 43 - protein, 1257 aa, Bacillus thuringiensis PS33F2
MATLNEVYPVNYNVLSSDAFQQLDTTGFKSKYDEMIKAFEKKWKKGAKGKDLLDVAWTYITTGEIDPLNVIKGVLSVLTLIPEVGTVASAASTIVSFIWPKIFGDKPNAKNIFEELKPQIEALIQQDITNYQDAINQKKFDSLQKTINLYTVAIDNNDYVTAKTQLENLNSILTSDISIFIPEGYETGGLPYYAMVANAHILLLRDAIVNAEKLGFSDKEVDTHKKYIKMTIHNHTEAVIKAFLNGLDKFKSLDVNSYNKKANYIKGMTEMVLDLVALWPTFDPDHYQKEVEIEFTRTISSPIYQPVPKNMQNTSSSIVPSDLFHYQGDLVKLEFSTRTDNDGLAKIFTGIRNTFYKSPNTHETYHVDFSYNTQSSGNISRGSSNPIPIDLNNPIISTCIRNSFYKAIAGSSVLVNFKDGTQGYAFAQAPTGGAWDHSFIESDGAPEGHKLNYIYTSPGDTLRDFINVYTLISTPTINELSTEKIKGFPAEKGYIKNQGIMKYYGKPEYINGAQPVNLENQQTLIFEFHASKTAQYTIRIRYASTQGTKGYFRLDNQELQTLNIPTSHNGYVTGNIGENYDLYTIGSYTITEGNHTLQIQHNDKNGMVLDRIEFVPKDSLQDSPQDSPPEVHESTIIFDKSSPTIWSSNKHSYSHIHLEGSYTSQGSYPHNLLINLFHPTDPNRNHTIHVNNGDMNVDYGKDSVADGLNFNKITATIPSDAWYSGTITSMHLFNDNNFKTITPKFELSNELENITTQVNALFASSAQDTLASNVSDYWIEQVVMKVDALSDEVFGKEKKALRKLVNQAKRLSKIRNLLIGGNFDNLVAWYMGKDVVKESDHELFKSDHVLLPPPTFHPSYIFQKVEESKLKPNTRYTISGFIAHGEDVELVVSRYGQEIQKVMQVPYEEALPLTSESNSSCCVPNLNINETLADPHFFSYSIDVGSLEMEANPGIEFGLRIVKPTGMARVSNLEIREDRPLTAKEIRQVQRAARDWKQNYEQERTEITAIIQPVLNQINALYENEDWNGSIRSNVSYHDLEQIMLPTLLKTEEINCNYDHPAFLLKVYHWFMTDRIGEHGTILARFQEALDRAYTQLESRNLLHNGHFTTDTANWTIEGDAHHTILEDGRRVLRLPDWSSNATQTIEIEDFDLDQEYQLLIHAKGKGSITLQHGEENEYVETHTHHTNDFITSQNIPFTFKGNQIEVHITSEDGEFLIDHITVIEVSKTDTNTNIIENSPINTSMNSNVRVDIPRSL

SEQ ID NO: 44 - protein, 803 aa, Bacillus thuringiensis PS63B
MTCQLQAQPLIPYNVLAGVPTSNTGSPIGNAGNQFDQFEQTVKELKEAWEAFQKNGSFSLAALEKGFDAAIGGGSFDYLGLVQAGLGLVGTLGAAIPGVSVAVPLISMLVGVFWPKGTNNQENLITVIDKEVQRILDEKLSDQLIKKLNADLNAFTDLVTRLEEVIIDATFENHKPVLQVSKSNYMKVDSAYFSTGGILTLGMSDFLTDTYSKLTFPLYVLGATMKLSAYHSYIQFGNTWLNKVYDLSSDEGKTMSQALARAKQHMRQDIAFYTSQALNMFTGNLPSLSSNKYAINDYNVYTRAMVLNGLDIVATWPTLYPDDYSSQIKLEKTRVIFSDMVGQSESRDGSVTIKNIFDNTDSHQHGSIGLNSISYFPDELQKAQLRMYDYNHKPYCTDCFCWPYGVILNYNKNTFRYGDNDPGLSGDVQLPAPMSVVNAQTQTAQYTDGENIWTDTGRSWLCTLRGYCTTNCFPGRGCYNNSTGYGESCNQSLPGQKIHALYPFTQTNVLGQSGKLGLLASHIPYDLSPNNTIGDKDTDSTNIVAKGIPVEKGYASSGQKVEIIREWINGANVVQLSPGQSWGMDFTNSTGGQYMVRCRYASTNDTPIFFNLVYDGGSNPIYNQMTFPATKETPAHDSVDNKILGIKGINGNYSLMNVKDSVELPSGKFHVFFTNNGSSAIYLDRLEFVPLDQPAAPTQSTQPINYPITSRLPHRSGEPPAIIWEKSGNVRGNQLTISAQGVPENSQIYLSVGGDRQILDRSNGFKLVNYSPTYSFTNIQASSSNLVDITSGTITGQVQVSNL

SEQ ID NO: 45 - protein, 1186 aa, Bacillus thuringiensis sotto PS80JJ1
MDCNLQSQQNIPYNVLAIPVSNVNALVDTAGDLKKAWEEFQKTGSFSLTALQQGFSASQGGAFNYLTLLQSGISLAGSFVPGGTFVAPIVNMVIGWLWPHKNKTADTENLIKLIDEEIQKQLNKALLDQDRNNWTSFLESIFDTSATVSNAIIDAQWSGTVDTTNRQQKTPTTSDYLNVVGKFDSADSSIITNENQIMNGNFDVAAAPYFVIGATLRLSLYQSYIKFCNSWIDAVGFSTNDANTQKANLARTKLTMRTTINEYTQRVMKVFKDSKNMPTIGTNKFSVDAYNVYVKGMTLNVLDMVAIWSSLYPNDYTSQTAIEQTRVTFSNMVGQEEGTDGTLKIYNTFDSLSYQHSLIPNNNVNLISYYTDELQNLELAVYTPKGGSGYAYPYGFILNYANSNYKYGDNDPTGKPLNKQDGPIQQINAATQNSKYLDGETINGIGASLPGYCTTGCSATEQPFSCTSTANSYKASCNPSDTNQKINALYAFTQTNVKGSTGKLGVLASLVPYDLNPKNVFGELDSDTNNVILKGIPAEKGYFPNNARPTVVKEWINGASAVPFYSGNTLFMTATNLTATQYKIRIRYANPNSDTQIGVLITQNGSQISNSNLTLYSTTDSSMSSNLPQNVYVTGENGNYTLLDLYSTTNVLSTGDITLKLTGGNQKIFIDRIEFIPTMPVPAPTNNTNNNNGDNGNNNPPHHGCAIAGTQQLCSGPPKFEQVSDLEKITTQVYMLFKSSSYEELALKVSSYQINQVALKVMALSDEKFCEEKRLLRKLVNKANQLLEARNLLVGGNFETTQNWVLGTNAYINYDSFLFNGNYLSLQPASGFFTSYAYQKIDESTLKPYTRYKVSGFIGQSNQVELIISRYGKEIDKILNVPYAGPLPITADASITCCAPEIDQCDGGQSDSHFFNYSIDVGALHPELNPGIEIGLKIVQSNGYITISNLEIIEERPLTEMEIQAVNRKDQKWKREKLLECASVSELLQPIINQIDSLFKDANWYNDILPHVTYQTLKNIIVPDLPKLKHWFIDHLPGEYHEIEQKMKEALKHAFTQLDEKNLIHNGHFATNLIDWQVEGDARMKVLENNALALQLSNWDSSVSQSIDILEFDEDKAYKLRVYAQGSGTIQFGNCEDEAIQFNTNSFVYKEKIIYFDTPSINLHIQSEGSEFVVSSIDLVELSDDE

SEQ ID NO: 46 - protein, 340 aa, Bacillus thuringiensis thompsoni
MAIMNDIAQDAARAWDIIAGPFIRPGTTPTNRQLFNYQIGNIEVEPGNLNFSVVPELDFSVSQDLFNNTSVQQSQTASFNESRTETTSTAVTHGVKSGVTVSASAKFNAKILVKSIEQTITTTVSTEYNFSSTTTRTNTVTRGWSIAQPVLVPPHSRVTATLQIYKGDFTVPVLLSLRVYGQTGTLAGNPSFPSLYAATYENTLLGRIREHIAPPALFRASNAYISNGVQAIWRGTATTRVSQGLYSVVRIDERPLAGYSGETRTYYLPVTLSNSSQILTPGSLGSEIPIINPVPNASCKKENSPIIIHHDREKHRERDYDKEHICHDQAEKYERDYDKE

SEQ ID NO: 47 - protein, 613 aa, Clostridium bifermentans malaysia CH18
MNTNIFSTHLEFSKGVASVFKVIDTIHNISKNNNFNNILTQDFIIDTILSILWEDPNENEIFSSMIEDGETITNKNLSAQTKEGLLLNSNSFGLKFKYYNNAFRSWIDNYNPTSIDDVVYRFKDVNSICENNINEFKVKNYEVTVLPIYMQIANLHLLLLRDGMIYGDAWNLYRELGFSDQDSFYNHVLDKTKFYINDCLNYYNTGLSNLKLDPNNSWIDITRYCRFMTFYILDMISICPIYDTKVYDKPINMQTLTRKVYSDPVNFIDENIPISEYEKMYNISPELFSTLFSISFYTNKSGNKFLNGHVNRHVGTDLNYNGLRETHYGNYGSNYEVESMAFDDIKAYSNNYFNNTQNNNPTSVKSIKFLITKNNDEWIYGEPDSSNIDFTRNIQGYLSNLNNESYTHSLSDMILANNDKIQINIDTPHSYSYSWIYKGIEDTNYISDKLINQIPLVKEVKLKSRHYSEISVIKGPGFTGGDLILSKVHKPANQIPAQYMKNKITIPIKTKFPAGSQDFKVRLCYASNHDIGLIRLIAGSKYITTNIQQTFNTTENNPSLIYDDFKYFNFNETLSITSSGIDELYLEFYYSYTDGNFEDFPKLSIPYTRNYSC

SEQ ID NO: 48 - protein, 618 aa, Clostridium bifermentans malaysia CH18
MNNKKIEQNKIVEYNSNLDIQPRELNTLNGLVFTGATVSIILPLIGTTAVVPVVGGVIGIIAALLPVIWPAGTSSNDNLFDAVMKDTEMIMDEKISEYVVNDAMTRLESLYNILDYYRLSKDFWEKNKDDPLAIAELKERFSKLHSQFIESMAYFKRANYEVLLLPAYANAANLHLLLLREGLLLNKVIDNFITEGLHYEEFKTKRSTYIAHCSTWYNKGLENIKNKTRDFNKINKYDAYMNLSVLDIISLFLSYDPYQYDKATKLQTLTRTVFSDPLQRAPRDLYISPKEETLFKNLKGLRAFFAEGDLVLTGFRNYFRNTYINDQIIEGDLFGYTTNNERYKLFTDSKIYKVTVFIDNVALAIVKLIFHDTDNKEWDFSKTDITDINKYRKEEVYLNLLSNNEIQKEPSHYLYKMHHYGDNYNDSYLFQWIHQSISPENYLFDKDKDDNYIITQIPAIKASELSNLGELSLQAIKGPRFTGGNVILSSVSKIDNNDPLYGGTIKIPLLTAFNNTSKFKIRIYYAANHNYNHDYIGALLTINSQHVANFKFKQTFSGEDYSNLSYNNYQFDYLVQTVAFPQNTSDVTLNLQFFYDPKFLNDYKQIVIIDKIEFIPEN

SEQ ID NO: 49 - protein, 706 aa, Paenibacillus popilliae
MNNNFNGGNNTGNNFTGNTLSNGICTKKNMKGTLSRTAIFSDGISDDLICCLDPIYNNNDNNNDAICDELGLTPIDNNTICSTDFTPINVMRTDPFRKKSTQELTREWTEWKENSPSLFTPAIVGVVTSFLLQSLKKQATSFLLKTLTDLLFPNNSSLTMEEILRATEQYVQERLDTDTANRVSQELVGLKNNLTTFNDQVEDFLQNRVGISPLAIIDSINTMQQLFVNRLPQFQVSGYQVLLLPLFAQAATLHLTFLRDVIINADEWNIPTAQLNTYTRYFKEYIAEYSNYALSTYDDGFRTRFYPRNTLEDMLQFKTFMTLNALDLVSIWSLLKYVNLYVSTSANLYNIGDNKVNEGAYPISYGPFFNSYIQTKSNYVLSGVSGIGARFTYSTVLGRYLHDDLKNIITTYVGGTQGPNIGVQLSTTELDELKKQQQATRDSLVDFQFFTLNCMLPNPITAPYFATSLYESRYSSIGGYLRKDVFKSEDSTCGLGNPGAWTSYPDYYITNISATVQINGENTDTTPLYFKENRPITSTRGVNKVIAVYNRKANIAGTNQNGTMIHQAPPDGTGFTVSPLHPSANTITSYIKENYGNSGDSLHLKGQGYLHYMLSGNGQDRYRLVLRLSGAANQIKLQSPTTSIYAFDTSTNNEGITDNGSKFKDFAFSTPFVIPEQKEIVLYFEGVGSLDLMNLIFLPADDTPLY

SEQ ID NO: 50 - protein, 675 aa, Paenibacillus popilliae
MNNNGNALSRTALTPTNNKVISGDLVTNGLPPIDNNIICSNGFMPINVTRKNPFRKRTTQEFIREWTEWKENSPSLFTAPIVGVVTSTLLEALKKQVQSRLLLLMTNLLFPNNSTSTMEEILRATEQYVQEQLDTVTWNRVSQELEGLKNNLRTFNDQIDDFLQNRVEISPTAMIDSINTMQQVFVNRLPQFQLSDYQLLLLPLFAQGATLHLTFIRDIIINAGEWNIPEAQLNTCKRYLKQYVAQYSNYALSTYEGAFRARFYPRATLENMLQFKTFMTLNVLDLVSIWSLLKYMNLYISTSANLYNIGDNKVNEGEYSISYWPFFNSYIQTKSNYVLSGVSGYAIRWYYLNTFFGEYIQDNLYNIIASYVGGVNGPKIGVQLSTTELDKQIKQQARAGMPTGLDDLSFNCTLRNPTTVPYFACNFQELTSSGTAGTGGFIRSDVFRSEDNICGLGTGYASAWTSYPDYYITNISATVQVDGINIDITPLCFGEDRAITSTHGVNKVIAVYNRKANIAGTNQNGTMIHQAPNDGTGFTVSPLHLASFTHPSEAHIQENYGNSGDSLRLTGPTTAITYMLSGDGRTIYKLVLRVSGVITRITAKVRGNSIGYLEYINTVDNNQGITDNGSKFQDFEFRPTITIDAQTPIVLEFSATSNFDLMNLIFIPYYDTPIY

SEQ ID NO: 51 - protein, 695 aa, Paenibacillus popilliae
MNNYFIGKVLSGHHINNNGNGNTLSRTALTPTNNNVNRGDLVTNGLTPIDNNFIGSNGFIPRNVTRKDPFRKRTTQEFIREWTEWKEKSASLFTAPIVGVITSTLLEALKKLVAGRVLMSLTNLLFPNNSTSTMEEILRATEQYIQEQLDTVTWNRVSQELEGLKNDLRTFNDQIDDFLQNRVGISPLAIIDSINTMQQLFVNRLPQFQVSDDQVLLLPLFAQAVTLHLTFVRDIIINADEWNIPEAQLNTYKRYLKQYVAQYSNYALSTYEEAFRARFYPRNTVENMLEFKTFMTLNVLDLVSMWSLLKYVNLYVSTSANLYNIGDNKVNEGEYSISYWPFFNTYIQTKSNYVLSGVSGYAMRWSYTNPFFGEYIQDHLYNITASYIGGVNGPQIGQQLSTTELDQLVQQQARADIPVDFTQIPINCTLRNPLEVPYYATRFNELTSLGTAGVGGFVRSDVFISNDSVCGLGTNYSSGQTFYPDYYITNISATVQVNGTNTDISPLYFGENRAITSTNGVNKVIAIYNRKTNYDDFTNIRGTIVHEAPTDSTGFTISPLHLDTVNINSYLYIQENYGNNGDSLRVINRAIIKYRLSAARSVIYRLVLRVSGTASSIVAIYENYPVGSANQINTGTDNEGVIDNDSKFIDLIFNTPFSVSGTARELQLQVSGATTSSPLDIMNIILIPINDVPLY

SEQ ID NO: 52 - protein, 648 aa, Bacillus thuringiensis jegathesan 367
MHYYGNRNEYDILNASSNDSNMSNTYPRYPLANPQQDLMQNTNYKDWLNVCEGYHIENPREASVRAGLGKGLGIVSTIVGFFGGSIILDTIGLFYQISELLWPEDDTQQYTWQDIMNHVEDLIDKRITEVIRGNAIRTLADLQGKVDDYNNWLKKWKDDPKSTGNLSTLVTKFTALDSDFNGAIRTVNNQGSPGYELLLLPVYAQIANLHLLLLRDAQIYGDKWWSARANARDNYYQIQLEKTKEYTEYCINWYNKGLNDFRTAGQWVNFNRYRREMTLTVLDIISMFPIYDARLYPTEVKTELTREIYSDVINGEIYGLMTPYFSFEKAESLYTRAPHLFTWLKGFRFVTNSISYWTFLSGGQNKYSYTNNSSINEGSFRGQDTDYGGTSSTINIPSNSYVYNLWTENYEYIYPWGDPVNITKMNFSVTDNNSSKELIYGAHRTNKPVVRTDFDFLTNKEGTELAKYNDYNHILSYMLINGETFGQKRHGYSFAFTHSSVDPNNTIAANKITQIPVVKASSINGSISIEKGPGFTGGDLVKMRADSGLTMRFKAELLDKKYRVRIRYKCNYSSKLILRKWKGEGYIQQQIHNISPTYGAFSYLESFTITTTENIFDLTMEVTYPYGRQFVEDIPSLILDKIEFLPTN

SEQ ID NO: 53 - protein, 682 aa, Bacillus thuringiensis higo
MNSYQNKNEYEILDAKRNTCHMSNCYPKYPLANDPQMYLRNTHYKDWINMCEEASYASSGPSQLFKVGGSIVAKILGMIPEVGPLLSWMVSLFWPTIEEKNTVWEDMIKYVANLLKQELTNDTLNRATSNLSGLNESLNIYNRALAAWKQNKNNFASGELIRSYINDLHILFTRDIQSDFSLGGYETVLLPSYASAANLHLLLLRDVAIYGKELGYPSTDVEFYYNEQKYYTEKYSNYCVNTYKSGLESKKQIGWSDFNRYRREMTLSVLDIVALFPLYDTGLYPSKDGKIHVKAELTREIYSDVINDHVYGLMVPYISFEHAESLYTRRPHAFTWLKGFRFVTNSINSWTFLSGGENRYFLTHGEGTIYNGPFLGQDTEYGGTSSYIDISNNSSIYNLWTKNYEWIYPWTDPVNITKINFSITDNSNSSESIYGAERMNKPTVRTDFNFLLNRAGNGPTTYNDYNHILSYMLINGETFGQKRHGYSFAFTHSSVDRYNTIVPDKIVQIPAVKTNLVGANIIKGPGHTGGDLLKLEYERFLSLRIKLIASMTFRIRIRYASNISGQMMINIGYQNPTYFNIIPTTSRDYTELKFEDFQLVDTSYIYSGGPSISSNTLWLDNFSNGPVIIDKIEFIPLGITLNQAQGYDTYDQNANGMYHQNYSNSGYNYNQEYNTYYQSYNN

SEQ ID NO: 54 - protein, 1176 aa, Bacillus thuringiensis kurstaki HD1
MDNNPNINECIPYNCLSNPEVEVLGGERIETGYTPIDISLSLTQFLLSEFVPGAGFVLGLVDIIWGIFGPSQWDAFPVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVLPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 55 - protein, 1176 aa, Bacillus thuringiensis kurstaki HD-1-02
MDNNPNINECIPYNCLSNPEVEVLGGGRIETGYTPIDISLSLTQFLLSEFVPGAGFVLGLVDIIWGIFGPSQWDTFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLGHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKIAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYSNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 56 - protein, 1176 aa, Bacillus thuringiensis kurstaki
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 57 - protein, 1176 aa, Bacillus thuringiensis Ly30
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 58 - protein, 1180 aa, Bacillus thuringiensis sotto
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNRITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 59 - protein, 1183 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQVTQIPLTKSTNLGSGTSVVKGPGFTGGDILRRTSPGQISTLRVNITAPLSQRYRVRIRYASTTNLQFHTSIDGRPINQGNFSATMCSGSNLQSGSFRTVGFTTPFNFPNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDEGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEEVDA

SEQ ID NO: 60 - protein, 1163 aa, Bacillus thuringiensis INTA Mol-12
NECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIGQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVE

SEQ ID NO: 61 - protein, 1175 aa, Bacillus thuringiensis LS-R-21
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLME

SEQ ID NO: 62 - protein, 934 aa, Bacillus thuringiensis sotto
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNRITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKR

SEQ ID NO: 63 - protein, 1176 aa, Bacillus thuringiensis aizawai IPL7; identical to SEQ ID NO: 57

SEQ ID NO: 64 - protein, 1176 aa, Bacillus thuringiensis entomocidus
MDNNPNINECIPYNCLSNPEVEVLGGERIETGYTPIDISLSLTQFLLSEFVPGAGFVLGLVDIIWGIFGPSQWDAFPVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 65 - protein, 1176 aa, Bacillus thuringiensis Fu-2-7
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRISTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 66 - protein, 620 aa, Bacillus thuringiensis kurstaki NRD-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQ

SEQ ID NO: 67 - protein, 1176 aa, Bacillus thuringiensis C12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEPEYRQPHLMDILNSITIYTDVHRGFNYWSGHQITTSPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVPMLSQAAGAVYTLRASLFLRLDPSAEFNNIIPSFTNYQIPLTKSTNLGSGTSVVKGPGFTGGDILRRTSPGLISTLRVNITAPLSQRYRVRIRYASTTNLQFHTSIDGRPINQGNFYATMSSGSNLQSGSFRTVGFTTPFNFSNGSSVFTLSAHVFNSGNEVYIDRIEFVPAEVTFEAEYDLERAQNGVNQLFTSSNQIGLKTDGTDYHIDQVSNLVECLSDEFCLDEKQELSEKVKHAKRLSDERNLLQDPNFRGINRQLDRGWRGSHDITIQGGDDVFKENYVTLLGTFDECYPTYLYQKIDQSKLKAYTSYQLRGYIEDSQDLEIYLIRYNAKQQTVNVPGTGSLWPVSAPKPIGKCGEPNRCAPHLEWNPDLDCSCRDGEKCAHHSHHFSLDIDVGCTDLNEDLGVWVIFKIKTEDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTGLPVGYVTKALEYFPETDKVWIEIGETEGTFIVDSVELLLMEE

SEQ ID NO: 68 - protein, 1180 aa, Bacillus thuringiensis dendrolimus T84A1; identical to SEQ ID NO: 58

SEQ ID NO: 69 - protein, 1155 aa, Bacillus thuringiensis berliner 1715
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 70 - protein, 1155 aa, Bacillus thuringiensis kurstaki S93; identical to SEQ ID NO: 69

SEQ ID NO: 71 - protein, 1155 aa, Bacillus thuringiensis c005; identical to SEQ ID NO: 69

SEQ ID NO: 72 - protein, 1155 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNLRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEELGVWVIFKIKTQDGHARLGNLEFLEEKPLVGEALARVKRAEKKWRDKREKLEWETNIVYKEAKESVDALFINSQYDRLQADTNIAMIHAADKRVHSIREAYLPELSVIPGVNAAIFEELEGRISTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 73 - protein, 1155 aa, Bacillus thuringiensis B-Hm-16; identical to SEQ ID NO: 69

SEQ ID NO: 74 - protein, 1155 aa, Bacillus thuringiensis AC-11
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYRVPLLSVYVQAVNLHLSVLRDVLVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDAVFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEEYGEGCVTIHEIENNTAELKFSNCVEEEVYPNNTVTCNDYTATQEEYEGTYTSRNRGYDGAYESNSSVPADYASAYEEKAYTDGRRDNPCESNRGYGDYTPLPAGYVTRELEYFPETDKVWIEIGETEGTFIVDSVELLLMEE

SEQ ID NO: 75 - protein, 1156 aa, Bacillus thuringiensis WB9
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLPVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIGAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCGAHHSHHFSLDIDVGCTDLNEDLGVWVIFKIKTQDGHARLGNLEFLEEKPLVGEALARVKRAEKKWRGKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 76 - protein, 1177 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWIRYNQFRRELTLTVLDIVSLFPNYDSRTYPIRTVSQLTREIYTNPVLENFDGSFRGSAQGIEGSIRSPHLMDILSSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQEVSEKVKHAKRLSDERNLLQDPNFRGINRQLDRGWRGSTDITIQGGDDVFKENYVTLPGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGCIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEIYPNNTVTCNDYTVNQEEYEGAYTSRNRGYNEAPSVPADYASVYEEKSYTDGRRENPCEFNRGYRDYTLLPVGYVTKELEYFPETDKVWIEIGETEGTFIVDSVELLLMEE

SEQ ID NO: 77 - protein, 1155 aa, Bacillus thuringiensis X-2
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDETEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSFNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHPADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMKE

SEQ ID NO: 78 - protein, 1156 aa, Bacillus thuringiensis kurstaki
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHRVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSGPDGGRICLWNLLKFGQPPYTEKAEPVDSPDEIPPQNNNVPPRQGFSHRCLAYVSMFYSGFSNSSVSVIRAPNDSSWTYCSAEFGDVIPSSQITQIPLTKLQSWLWNSVVKGLGFTGGDILEELTGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGNTDITIQGGHDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 79 - protein, 1155 aa, Bacillus thuringiensis C008
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNPGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 80 - protein, 1155 aa, Bacillus thuringiensis IS5056
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSPLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 81 - protein, 1155 aa, Bacillus thuringiensis S2491Ab
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVLVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERSLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWEIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRRYDGAYESNFSVPADYASAYEEKAYTDGRRDNPCESNRGYGDYTPLPAGYVTKELECFPETDKVWIEIGETEGTFIVDSVELLLMEE

SEQ ID NO: 82 - protein, 1154 aa, Bacillus thuringiensis LS-R-30
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLME

SEQ ID NO: 83 - protein, 1155 aa, Bacillus thuringiensis serovar kurstaki
  misc_feature: Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGHRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPESTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKAPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLDIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADERVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDEPKFSYCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 84 - protein, 1155 aa, Bacillus thuringiensis kurstaki HD1; identical to SEQ ID NO: 69

SEQ ID NO: 85 - protein, 1155 aa, Bacillus thuringiensis kurstaki HD1; identical to SEQ ID NO: 69

SEQ ID NO: 86 - protein, 1155 aa, Bacillus thuringiensis berliner 1715
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYLTYLYQKIDESKLKAYTRYQLRGYIEDSQDLEIYLIRYNAKHETVNVPGTGSLWRLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 87 - protein, 1155 aa, Bacillus thuringiensis kurstaki NRD-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSANFNNIIPSSQITQIPLTKSTNLGSGTSVVKGPGFTGGDILRRTSPGQISTLRVNITAPLSQRYRVRIRYASTTNLQFHTSIHGRPINQGNFSATMSSGSNLQSGSFRHLGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKEELSEKVKHANGLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGILEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGTGCVTIHEIENNTDELKFSNCVEEEVYPNNTVTCNDYTATQEEYGGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 88 - protein, 1155 aa, Bacillus thuringiensis aizawai IC1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRPPMFSWIHRSAEFNNIIPSSQITQIPLTKSTNLGSGTSVVKGPGFTGGDILRRTSPGQISTLRVNITAPLSQRYRVRIRYASTTNLQLHTSIDGRIINQGNFSATMSSGSNLQSGSFRIVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYLTYLYQKIDESKLKAYTRYQLRGYIEDSQDLEIYLIRYNAKHETVNVPGTGSLWRLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 89 - protein, 1155 aa, Bacillus thuringiensis aizawai IPL7
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRALAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNFVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 90 - protein, 1155 aa, Bacillus thuringiensis aizawai HD133; identical to SEQ ID NO: 69

SEQ ID NO: 91 - protein, 1118 aa, Bacillus thuringiensis kunthala RX24
MDNNLNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGAFMTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYLTLLGTFDECFQRIYIKKVDESKFKAYTRDQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCKIILRLKKNMRVRTLLVIEDMTEPMKAILLYQLIMHQPMKKKHIQMDEETILVNLTEDMGITHHYQLAM

SEQ ID NO: 92 - protein, 1118 aa, Bacillus thuringiensis kunthala RX28
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRREITLTVLDIVALFPNYDSRTYPIRTVSQLTREIYTNPVLENFDGSFRGSAQGTERSIRSPHLMDILNSITIYRMHIEDIIIGQGIKKRLLLEGFQGQNSLFLYLGRGEMQLHPNRLLLNKVRACIEHYRPLYIEDLFKEGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECFQRIYIKKVDESKFKAYTRDQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCKIILRLKKNMRVRTLLVIEDMTEPMKAILLYQLIMHQPMKKKHIQMDEETILVNLTEDMGITHHYQLAM

SEQ ID NO: 93 - protein, 373 aa, Bacillus thuringiensis ly4a3
RDMTVIVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDKIEFIP

SEQ ID NO: 94 - protein, 1178 aa, Bacillus thuringiensis kurstaki HD73
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 95 - protein, 1178 aa, Bacillus thuringiensis kurstaki YBT-1520; identical to SEQ ID NO: 94

SEQ ID NO: 96 - protein, 1178 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 97 - protein, 723 aa, Bacillus thuringiensis kurstaki HD1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLS

SEQ ID NO: 98 - protein, 1177 aa, Bacillus thuringiensis Ly30
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLGEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGYVTIHEIENNTDELKFSNCVEEEIYPNNTVTCNDYTVNQEEYGGAYTSRSRGYNEAPSVPADYASVYEEKSYTDGRRENPCEFNRGYRDHTPLPVGYVTKELEYFPETDKVWIEIGETEGTFIVDSVELLLMEE

SEQ ID NO: 99 - protein, 1177 aa, Bacillus thuringiensis from Taiwan
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 100 - protein, 1178 aa, Bacillus thuringiensis H3
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSTQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 101 - protein, 1177 aa, Bacillus thuringiensis kenyae HD549
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 102 - protein, 1177 aa, Bacillus thuringiensis SK-729
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRFAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVESLLMEE

SEQ ID NO: 103 - protein, 1178 aa, Bacillus thuringiensis C-33
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVLLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPVDYASVYEEKSYTDGRRENPCEFNRGYRDYTPLPVGYVTKELEYFPETDKVWIEIGETEGTFIVDSVELLLMEE

SEQ ID NO: 104 - protein, 1177 aa, Bacillus thuringiensis kenyae
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRFAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 105 - protein, 1177 aa, Bacillus thuringiensis
MDNNPNTNECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 106 - protein, 1164 aa, Bacillus thuringiensis INTA Mol-12
NECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVE

SEQ ID NO: 107 - protein, 1178 aa, Bacillus thuringiensis W015-1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFTRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIMRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIKIGETEGTFIVDSVELLLMEE

SEQ ID NO: 108 - protein, 960 aa, Bacillus thuringiensis serovar kurstaki
  misc_feature (560)..(560): Xaa can be any naturally occurring amino acid
MDNNPNTNECIPYNCLSNPEVEVLGGERIETGYTPIDISLSLTQFLLSEFVPGAGFVLGLVDIIWGIFGPSQWDDAFLVQIEQLINQRIEEFARNPAISRLEGGLSNLYQIYAESFREWEADPTNPALREEMRIQFNDMNSALTTAIPLLAVQNYQVPLLSVYVQAANLHYSVLRDVSVFGQRWGFDAAATINSRYNDLTSPIGNYTDYAVRWYNTGLERVWGPDSRDWVRYNQFRRELTLTVLDIVALLFPNYDSRRRRYPIRTVSQLTREIYTNPVLENFDGSSFRGSAQGIERSSIRSPHLMDILNSITIYTDAHRGYYYCSGHQIMASPVGFSGPEFTFPLYGTMGNAAPQQRMVAQLGQGVYRTLSSSTYYRRPFNIGINNQQLSVLDGTEFAYGTSSNLPSAVYRKSGTVDSLDEIPPQNNNVPPRQGFSHRLSHVSMFRSGFSNSSVSIISAPMFSWIHRSAEFNNTIASDSITQIPAAVKGNFLFNGSVISGPGFTGGDLVRLNSSGNNIQNRGYIEVPIHFPSTSTRYRVRVRYASVTPIHLNVNWGNSSXSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIIQGGDDVFKENYVTLSGTFDECYPTYLYQKIDESKLKAFTRYQLRGYIEDSQDLEIYLIRYNAKHETVNRYGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAAADDNRVHSIREAYL

SEQ ID NO: 109 - protein, 1177 aa, Bacillus thuringiensis 146-158-01
MDNNPNINECNPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNFQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 110 - protein, 1177 aa, Bacillus thuringiensis Tm37-6
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYSQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPTFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLHQKIDESKLKAFTRHQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 111 - protein, 1177 aa, Bacillus thuringiensis Tm41-4
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSYSVPLGGG

SEQ ID NO: 112 - protein, 1177 aa, Bacillus thuringiensis Tm44-1B
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAASQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVQYPVTEE

SEQ ID NO: 113 - protein, 1178 aa, Bacillus thuringiensis Q-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQVMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMLSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSSTFDECYPTYLYQKIDESKLKAFTRYRLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 114 - protein, 1164 aa, Bacillus thuringiensis INTA TA24-6; identical to SEQ ID NO: 106

SEQ ID NO: 115 - protein, 618 aa, Bacillus thuringiensis BTS89A
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLE

SEQ ID NO: 116 - protein, 1178 aa, Bacillus thuringiensis S1478-1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIRVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 117 - protein, 1178 aa, Bacillus thuringiensis S3299-1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEMCAHHSHHFSLDIDVGCTDLNEDLGVWVIFKIKTQDGHARLGNLEFLEEKPLVGEALARVKRAEKKWRDKRGKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETGGTFIVDSVELLLMEE

SEQ ID NO: 118 - protein, 1177 aa, Bacillus thuringiensis ZQ-89
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAKIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 119 - protein, 1172 aa, Bacillus thuringiensis SK-711
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIAPDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRFAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVEL

SEQ ID NO: 120 - protein, 608 aa, Bacillus thuringiensis SK-783
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVT

SEQ ID NO: 121 - protein, 1178 aa, Bacillus thuringiensis kurstaki PS85A1
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 122 - protein, 1177 aa, Bacillus thuringiensis kurstaki PS81GG; identical to SEQ ID NO: 101

SEQ ID NO: 123 - protein, 607 aa, Bacillus thuringiensis kurstaki NRD-12
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPV

SEQ ID NO: 124 - protein, 1178 aa, Bacillus thuringiensis kurstaki HD73; identical to SEQ ID NO: 94

SEQ ID NO: 125 - protein, 1178 aa, Bacillus thuringiensis kurstaki HD73; identical to SEQ ID NO: 94

SEQ ID NO: 126 - protein, 1178 aa, Bacillus thuringiensis DSIR732; identical to SEQ ID NO: 94

SEQ ID NO: 127 - protein, 1179 aa, Bacillus thuringiensis aizawai PS81I
MEIMNNQNQCVPYNCLNDPTIEILEGERIETGYTPIDISLSLTQFLLSEFVPGAGFVLGLIDLIWGFVGPSQWDAFLVQIEQLINQRIEEFARNQAISRLEGLSNLYQIYAEAFREWEADPTNPALTEEMRIQFNDMNSALTTAIPLFTVQNYQVPLLSVYVQAANLHLSVLRDVSVFGQRWGFDVATINSRYNDLTRLIGTYTDYAVRWYNTGLERVWGPDSRDWVRYNQFRRELTLTVLDIVSLFPNYDSRTYPIRTVSQLTREIYTNPVLENFDGSFRGMAQRIEQNIRQPHLMDLLNSITIYTDVHRGFNYWSGHQITASPVGFAGPEFTFPRYGTMGNAAPPVLISTTGLGIFRTLSSPLYRRIILGSGPNNQNLFVLDGTEFSFASLTADLPSTIYRQRGTVDSLDVIPPQDNSVPARAGFSHRLSHVTMLSQAAGAVYTLRAPTFSWRHRSAEFSNLIPSSQITQIPLTKSINLGSGTSVVKGPGFTGGDILRITSPGQISTLRVTITAPLSQRYRVRIRYASTTNLQFHTSIDGRPINQGNFSATMSSGGNLQSGSFRTAGFTTPFNFSNGSSIFTLSAHVFNSGNEVYIERIEFVPAEVTFEAEYDLERAQEAVNALFTSSNQLGLKTNVTDYHIDQVSNLVECLSGEFCLDEKRELSEKVKHANRLSDERNLLQDPNFRGINRQPDRGWRGSTDITIQGGDDVFKENYVTLPGTFNECYPTYLYQKIDESKLKAYTRYQLRGYIEDSQHLEIYLIRYNTKHETVNVPGTGSLWPLSVENPIGKCGEPNRCAPQLEWNPDLDCSCRDGEKCAHHSHHFSLDIDIGCTDLNENLGVWVIFKIKMQDGHARLGNLEFLEEKPLVGESLARVKRAEKKWRDKREKLQVETNIVYKEAKESVDALFVNSQYDRLQADTDIAMIHAADKRVHRIREAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNDYTANQEEYGGAYTSRNRGYGESYESNSSIPAEYAPVYEEAYIDGRKENPCESNRGYGDYTPLPAGYVTKELEYFPETDKVWIEIGETEGTFIVDSVELLLMEE

SEQ ID NO: 128 - protein, 1179 aa, Bacillus thuringiensis PS81RR1
MEIMNNQNQCVPYNCLNDPTIEILEGERIETGYTPIDISLSLTQFLLSEFVPGAGFVLGLIDLIWGFVGPSQWDAFLVQIEQLINQRIEEFARNQAISRLEGLSNLYQIYAEAFREWEADPTNPALTEEMRIQFNDMNSALTTAIPLFTVQNYQVPLLSVYVQAANLHLSVLRDVSVFGQRWGFDVATINSRYNDLTRLIGTYTDYAVRWYNTGLERVWGPDSRDWVRYNQFRRELTLTVLDIVSLFPNYDSRTYPIRTVSQLTREIYTNPVLENFDGSFRGMAQRIEQNIRQPHLMDLLNSITIYTDVHRGFNYWSGHQITASPVGFAGPEFTFPRYGTMGNAAPPVLISTTGLGIFRTLSSPLYRRIILGSGPNNQNLFVLDGTEFSFASLTADLPSTIYRQRGTVDSLDVIPPQDNSVPARAGFSHRLSHVTMLSQAAGAVYTLRAPTFSWRHRSAEFSNLIPSSQITQIPLTKSINLGSGTSVVKGPGFTGGDILRRTSPGQISTLRVTITAPLSQRYRVRIRYASTTNLQFHTSIDGRPINQGNFSATMSSGGNLQSGSFRTAGFTTPFNFSNGSSIFTLSAHVFNSGNEVYIDRIEFVPAEVTFEAEYDLERAQEAVNALFTSSNQLGLKTNVTDYHIDQVSNLVECLSGEFCLDEKRELSEKVKHAKRLSDERNLLQDPNFRGINRQPDRGWRGSTDITIQGGDDVFKENYVTLPGTFNECYPTYLYQKIDESKLKAYTRYQLRGYIEDSQDLEIYLIRYNTKHETVNVPGTGSLWPLSVENPIGKCGEPNRCAPQLEWNPDLDCSCRDGEKCAHHSHHFSLDIDIGCTDLNENLGVWVIFKIKTQDGHARLGNLEFLEEKPLVGESLARVKRAEKKWRDKREKLQVQTNIVYKEAKESVDALFVNSQYDRLQADTDIAMIHAADKRVHRIREAYLPELSVIPGVNAGIFEELEGRIFTAYSLYDARNLIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNDYTANQEQYGGAYTSRNRGYGESYESNSSIPAEYAPVYEEAYIDGRKENPCESNRGYGDYTPLPAGYVTKELEYFPETDKVWIEIGETEGTFIVDSVELLLMEE

SEQ ID NO: 129 - protein, 1181 aa, Bacillus thuringiensis alesti
MDNNPKINECIPYNCLSNPEVEVLGGERIETGYTPIDISLSLTQFLLSEFVPGAGFVLGLIDLIWGFVGPSQWDAFLVQIEQLISQRIEEFARNQAISRLEGLSNLYQIYAEAFREWEADPTNPALREEMRIQFNDMNSALTTAIPLFTVQNYQVPLLSVYVQAVNLHLSVLRDVSVFGQRWGLDVATINSRYNDLTRLIGTYTDYAVRWYNTGLERVWGPDSRDWVRYNQFRRELTLTVLDIVSLFPNYDSRTYPIRTVSQLTREIYTNPVLENFDGSFRGSAQRIEQSIRSPHLMDILNSITIYTDAHGGYYYWSGHQIMASPVGFSGPEFTFPLYGTMGNAAPQQRIVAQLGQGVYRTLSSTFYRNPFIIGINNQRLSVLDGTEFAYGSSSNLPSAVYRKSGTVDSLDEIPPQDNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGGNLQSGSFRTVGFTTPFNFSNGSSVFTLSAHVFNSGNEVYIDRIEFVPAEVTFEAEYDLERAQEAVNALFTSPNQIGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSFESSIGKCGEPNRCAPHLEWNPDLDCSCRDGEKCAHHSHHFSLDIDVGCIDLNEDLGVWVIFKIKTQDGHARLGNLEFLEEKPLVGEALARVKRAEKKWRDKREKLQLETNIVYKEAKESVDALFVNSQYDQLQADTNIAMIHTADKRVHRIQEAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNEYTANQEEYGGAYTSCNRGYDETYGSNYSVPADYASVYEEKAYTDGRRENPCESNRGYGDYTPLPAGYVTKQLEYFPETDKVWIEIGETEGTFIVDSVELFLMEE

SEQ ID NO: 130 - protein, 911 aa, Bacillus thuringiensis NT0423
MDNNPNINECIPYNCLSNPEVEVLGGERIETGYTPIDISLSLTQFLLSEFVPGAGFVLGLVDIIWEIFSVLSSDAFLVQIEQLINQRIEEFARNQAISRLEGLSNLYQIYAESFREWEADPTNPALREEMRIQFNDMNSALTTAIPLFAVQNYQVPLLSVYVTCNYIISSESVMCGQRSGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNSAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRILYASTTNLQFHTSIDGRPINQGNFSATMSSGRNLQSGSLRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRRSTDITTQGGDDFFQENYVTLLGTLMGFPSIYIKKWWFEIKSLYPLPIRGYIEDSQDLEIYLIRYNAKHETVNVPGTVPYGRFQPQVPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREA

SEQ ID NO: 131 - protein, 1176 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEPEYRQPHLMDILNSISIYTDVHRGFNYWSGHQITTSPVGFSGPEFTFPLYGTYGNAAPPQRIAQTGLGIFRTLSSPLYRRIILGSGPNNQELFVLDGTEFSFASLTTNLPSTIYRQRGTVDSLDVIPPQDNSVPPRAGFSHRLSHVPMLSQAAGAVYTLRASLFLLLVLLIHARSIFNNIIPSSQITQSFKKIISWTSVVKGPGFTGGDILRRPSPGLISTLRVNITAPLSQRYRVRIRYAFTTNLQFLTSIDGRPINQGNFYATMSSGSNLQSGSFRTVGFTTPFNFSNGSSVFTLSAHVFNSGNEVYIDRIEFVPAEVTFEAEYDLERAQNGVNQLFTSSNQIGLKTDGTDYHIDQVSNLVECLSDEFCLDEKQELSEKVKHAKRLSDERNLLQDPNFRGINRQLDRGWRGSHDITIQGGDDVFKENYVTLLGTFDECYPTYLYQKIDQSKLKAYTSYQLRGYIEDSQDLEIYLIGYNAKQQTVNVPGTGSLWPVYAPKPIGKCGEPNRCAPHLEWNPDLDCSCRDGEKCAHHSLHFSIDIDVGCTDLNEDLGVWVIFKIKTEDGHARLGNLEFLEEKPLVGEALARVKRAEKKWRDKRVKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYFPRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTGLPVGYVTKALEYFPETDKVWIEIGETEGTFIVDSVELLLMEE

SEQ ID NO: 132 - protein, 1182 aa, Bacillus thuringiensis
MKNSIKLSELWYFNERKWRYFMEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGVDDVFKENYVTLSGTFDECYPTYLYQKIDESKLKAFTRYQLRGYIEDSQDLEVYLIRYNAKHETLNVPGTGSLWPLAVKSPIGRCGEPNRCAHHSHHFSLDIDVGCTDLNEDLGVWVIFKIKTQDGHAKIGNLEFLEEKLLLGEALARVKKAEKKWRDKREKLEWETNIVYKEAKESVDALFVDSQYNRLQTDTNIAMIHAADKRVHRIREAYLPELSVIPGVNAAIFEELEGLIFTAFSLYDARNVIKNGDFNYGLSCWNVKGHVDVEEQNNHRSVLVIPEWEAEVSQEVRVCPGRGYILRVTAYKEGYGEGCVTIHEIEDNTDELKFSNCVEEEVYPNNTVTCNDYTATQEEYEGTYTSRNRGYDGAYESNSSVPADYASAYEEKAYTDGRRDNPCESNRGYRDYTPLPAGYVTKELEYFPETDKVWIEIGETEGTFIVDSVELLLMEE

SEQ ID NO: 133 - protein, 850 aa, Bacillus thuringiensis alesti
MEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEVYLIRYNAKHETLNVPGTGSLWPLAVKSPIGRCGEPNRCAHHSHHFSLDIDVGCTDLNEDLGVWVIFKIKTQDGHAKIGNLEFLEEKL

SEQ ID NO: 134 - protein, 1181 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEVYLIRYNAKHETLNVPGTGSLWPLAVKSPIGRCGEPNRCAPRIEWKPDVDCSCRDGEKCAHHSHHFSLDIDVGCTDLNEDLGVWVIFKIKTQDGHAKIGNLEFLEEKLLLGEALARVKKAEKKWRDKREKLEWETNIVYKEAKESVDALFVDSQYNRLQTDTNIAMIHAADKRVHRIREAYLPELSVIPGVNAAIFEELEGLIFTAFSLYDARNVIKNGDFNYGLSCWNVKGHVDVEEQNNHRSVLVIPEWEAEVSQEVRVCPGRGYILRVTAYKEGYGEGCVTIHEIEDNTDELKFSNCVEEEVYPNNTVTCNDYTATQEEYEGTYTSRNRGYDGAYESNSSVPADYASAYEEKAYTDGRRDNPCESNRGYRDYTPLPAGYVTKELEYFPETDKVWIEIGETEGTFIVDSVELLLMEE

SEQ ID NO: 135 - protein, 1155 aa, Bacillus thuringiensis kunthala nags3
MDNNPNINECIPYNCLSNPEVEVLGGERIETGYTPIDISLSLTQFLLSEFVPGAGFVLGLVDIIWGIFGPSQWDAFLVQIEQLINQRIENSLGTKPFLDWKAKQSLSNLRRIFREWEADPTNPALREEMRIQFNARTSALTTAIPLFAVQNYQVPLLSVYVQAANLMFSTRRVQPFSRVVAVTPGYQSRYNFKRCYWGAREFLEDVGAIRDKSNFKKEDSKQLCCYLGIFRLSSYFFKIYEKFRTRVYPISESKFSPINKRNLYKPSIKKFSMVVFEARLRARRKYWSPHLWIYLNQDNHLTDVHRGFNYWSGHQIIASPVGFQDPEFAFPLFGNAGNAAPPVRIVYQLGQGVYRTLSSTLYEDLFIRDKVINTYLFLAGSNLLMEPPHICHPGRYRKSGTVDSLDEIPHQNNNVPPRQGFSHRLSHVSMFRSGFSNSSVSIIRAPMFSWILRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSASFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLESIYIRESVESESVDAPRMESDLRLFGRDGQKMCPSFPSFLLRHYVGCTDLNEDLGVWVIFKIKTQDGHARLGNLEFLEEKPLVGEALARVKRAEKKWRDKREKLEWETNIVYKEAKESVHALFVNSQYDQLQAETNIAMIHAADKRVHSIRKAYLPELAVIPGVNAGIFEELEGRIFTAFSLYDARNVIKNGAFEYMAYPAGTERACRCRRTKQPPFGPCCSGMGSRSVTRSSCLSGSWLYPSCHSVQGGIGEGCVTIHEIENNTDELKFSNCVEEEVYPNNTVTCKIILRLKKNRRVPYTSRNRGYDGAYESNSSVQLIMHQPMKKKHIQMDEETILVNLTEDMGITHHYQRGYVTKELEYFQKPIRYGLRSEKRKEHSSWTAWNYFLWRNNICFIM

SEQ ID NO: 136 - protein, 1228 aa, Bacillus thuringiensis thuringiensis HD2
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILRVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 137 - protein, 1228 aa, Bacillus thuringiensis entomocidus HD110
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLHTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILRVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 138 - protein, 1228 aa, Bacillus thuringiensis
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIEAAAIRSPHLLDFLEQLTIFSASSRWSNTRHMTYWRGRTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILRVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 139 - protein, 1228 aa, Bacillus thuringiensis entomocidus HD9; identical to SEQ ID NO: 137

SEQ ID NO: 140 - protein, 1228 aa, Bacillus thuringiensis sfw-12; identical to SEQ ID NO: 136

SEQ ID NO: 141 - protein, 1228 aa, Bacillus thuringiensis S601
MTSNRKNENEIINAVSNHSAQMDLLPDARIEDSLCIAEGNNIDPFVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVERTRDYSDYCVEWYNTGLNSLRGTNAASWVRYNQFRRGLTLGVLGLVALFPSYDTRTYPINTSAQLTREVYTDAIGATGVNMASMNWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFASRGGTTVNNFRFLRTMNSGDELKYGNFVRRAFTTPFTFTQIQNIIRTSIQGLSGNGEVYIDKIEIIPVTATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVSKENYVTLPGTFNECYPTYLYQKIGESELKAYTRYQLEGYIEDSQDLEIYLIRYNAKHETLDVPGTESLWPLSVESPIGRCGEPNRCAPHFEWNPDLDCSCRDGEKCAHHSHHFSLDIDVGCTDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELPVIPGVNAEIFEELEGHIITAISLYDARNVVKNGDFNNGLTCWNVKGHVDVQQSHHRSDLVIPEWEAEVSQAVRVCPGCGYILSVTAYKEGYGEGCVTIHEIENNTDELKFKNREEEEVYPTDTGTCNDYTAHQGTAGCADACNSRNAGYEDAYEVDTTASVNYKPTYEEETYTDVRRDNHCEYDRGYVNYPPVPAGYVTKELEYFPETDTVWIEIGETEGKFMVDSVELLLMEE

SEQ ID NO: 142 - protein, 1229 aa, Bacillus thuringiensis EG5847
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFPSINELSEHGWWGSANVTIQEGNDVFKENYVTLPGTFNECYPNYLYQKIGESELKAYTRYQLRGYIEDSQDLEIYLIRYNAKHETLDVPGTDSLWPLSVESPIGRCGEPNRCAPHFEWNPDLDCSCRDGERCAHHSHHFTLDIDVGCTDLHENLGVWVVFKIKTQEGYARLGNLEFIEEKPLIGEALSRVKRAEKKWRDKREKLQLETKRVYTEAKEAVDALFVDSQYDQLQADTNIGMIHAADKLVHRIREAYLSELPVIPGVNAEIFEELEGHIITAMSLYDARNVVKNGDFNNGLTCWNVKGHVDVQQSHHRSDLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 143 - protein, 1233 aa, Bacillus thuringiensis morrisoni
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFPSINELSEHGWWGSANVTIQEGNDVFKENYVTLPGTFNECYPNYLYQKIGESELKAYTRYQLRGYIENSQDLEIYLIRYNAKHEAINVPGTESIWSISAESTIGKCTEPNRCAPHYEWNPDLDCSCRDGEKCAHHSHHSTLDIDVGCTDLHENLGVWLIFKIKTQDGHARLGNLEYLEEKPLLGEALRRVKRTEKKWRDKREKLHLETKRVYTEAKESVDALFVDSQYDRLQANSNIGMIHAADKLVHSIREAYLSELPVIRGVNADIFEELEGHILTAFSLYDARNAVKNGDFNNGLTCWNVKGHVDVQQSHHRFDLVVPEWKAEVSQAVRVCPGCGYILRVTAYKEGYGEGCVTIHEIEENTDELNFKNRVEEEIYPPDTGTCKYYTENQGTRTCGNECGSRNEGYDNAYEINAKSSLEYRPTYEEETYTDVRRENHCEYARGYINYSPVPAGYVTKELEYFPETDTVWIEIGETEGKFIVDSVELLLMEE

SEQ ID NO: 144 - protein, 1231 aa, Bacillus thuringiensis wuhanensis HD525
MTSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFTSINELSEHGWWGSENVTIQEGNDVFKENYVTLPGTFNECYPNYLYQKIGESELKAYTRYQLRGYIEDSQDLEIYLIRYNAKHETLDVPGTDSLWPLSVKSPIGRCGEPNRCAPHFEWNPDLDCSCRDGERCAHHSHHFTLDIDVGCTDLHENLGVWVVFKIKTQEGYARLGNLEFIEEKPLIGEALSRVKRAEKKWRDKREKLQLETKRVYTEAKETVDALFVDSHYNRLQADTNIGMIHAADRLVHRIHEAYLPELPFIPGINAVIFEELENRISTAFSLYDARNVIKNGDFNNGLSCWNVKGHVDVQQSHHRSDLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 145 - protein, 1231 aa, Bacillus thuringiensis 834
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWDRFNFINPQNIYERGATTYSQPYQGVGIQLFDSETELPPETTERPNYESYSHRLSHIGLIIGNTLRAPVYSWTHRSADRTNTIGPNRITQIPAVKGRFLFNGSVISGPGFTGGDVVRLNRNNGNIQNRGYIEVPIQFTSTSTRYRVRVRYASVTSIELNVNLGNSSIFTNTLPATAASLDNLQSGDFGYVEINNAFTSATGNIVGARNFSANAEVIIDRFEFIPVTATFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFTSINELSEHGWWGSENVTIQEGNDVFKENYVTLPGTFNECYPNYLYQKIGESELKAYTRYQLRGYIEDSQDLEIYLIRYNAKHETLDVPGTDSLWPLSVKSPIGRCGEPNRCAPHFEWNPDLDCSCRDGERCAHHSHHFTLDIDVGCTDLHENLGVWVVFKIKTQEGYARLGNLEFIEEKPLIGEALSRVKRAEKKWRDKREKLQLETKRVYTEAKETVDALFVDSHYNRLQADTNIGMIHAADRLVHRIHEAYLPELPFIPGINAVIFEELENRISTAFSLYDARNVIKNGDFNNGLSCWNVKGHVDVQQSHHRSDLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 146 - protein, 1227 aa, Bacillus thuringiensis PS158C2
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVILPGTFNECYPTYLYQKIGEAELKAYTRYQLSGYIEDSQDLEIYLIRYNAKHETLDVPGTESVWPLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYMTKELEYFPETDKVWIEIGETEGKFIVDSVELLLMEE

SEQ ID NO: 147 - protein, 1227 aa, Bacillus thuringiensis
LTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEHLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTWTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFNSNNEQSNFTSIHEQSEHGWWGSENITIQEGNDVFKENYVTLPGTFNECYPTYLYQKIGEAELKAYTRYQLSGYIEDSQDLEIYLIRYNAKHETLDVPGTESVWPLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAVCNSRNAGYEDAYEVDTTASVNYKPTYEEETYTDVRRDNHCEYDRGYVNYPPVPAGYMTKELEYFPETDKVWIEIGETEGKFIVDSVELLLMEE

SEQ ID NO: 148 - protein, 1227 aa, Bacillus thuringiensis g9
MNSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSPEDWLGNRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESLAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLSGYIEDSQDLEIYLIRYNAKHETLDVPGTESVWSLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRTREAYLSELSVIPGVNAEIFEELEGRIITAISLYDARNVVKNGDFNNGLAFWNVKGHVDVQQSHHRSVLVIPEWEAEVSQEVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPLPAGYVTKELEYFPETDKVWIEIGETEGKFIVGSVELLLMEE

SEQ ID NO: 149 - protein, 1228 aa, Bacillus thuringiensis
MTSNRKNENEIINALSIPAVSNHSTQMDLSPDARIEDSLCIAEGNNINPLVSASTVQTGINIAGRILGVLGVPFAGQIASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVEQTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIETAVIRSPHLLDFLEQLTIFSTSSRWSATRHMTYWRGHTIQSRPIGGGLNTSTHGSTNTSINPVRLSFFSRDVYWTESYAGVLLWGIYLEPIHGVPTVRFNFRNPQNTFERGTANYSQPYESPGLQLKDSETELPPETTERPNYESYSHRLSHIGLISQSRVHVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESVWPLSVESPIGRCGEPNRCAPHFEWNPDLDCSCRDGEKCAHHSHHFSLDIDIGCTDLHENLGVWVVFKIKTQEGHARLGNLEFIEEKPLLGEALSRVKRAEKKWRDKREKLQLETKRVYTEAKEAVDALFVDSQYNRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAVCNSRNAGYEDAYEVDTTASVNYKPTYEEETYTDVRRDNHCEYDRGYVNYPPLPAGYMTKELEYFPETDKVWIEIGETEGKFIVDSVELLLMEE

SEQ ID NO: 150 - protein, 1228 aa, Bacillus thuringiensis
MTSNRKNENEIINALSIPAVSNHSTQMDLSPDARIEDSLCIAEGNNINPLVSASTVQTGINIAGRILGVLGVPFAGQIASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSEFGLTSQEIQRYYERQVEQTRDYSDYCVEWYNTGLNSLRGTNAASWVRYNQFRRDLTLGVLDLVALFPSYDTRTYPINTSAQLTREVYTDAIGATGVNMASMNWYNNNAPSFSAIETAVIRSPHLLDFLEQLTIFSTSSRWSATRHMTYWRGHTIQSRPIGGGLNTSTHGSTNTSINPVRLSFFSRDVYWTESYAGVLLWGIYLEPIHGVPTVRFNFRNPQNTFERGTANYSQPYESPGLQLKDSETELPPETTERPNYESYSHRLSHIGLISQSRVHVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTDVTDYHIDQVSNLVACLSDEFCLDEKRELLEKVKYAKRLSDERNLLQDPNFTSINKQPDFISTNEQSNFTSIHEQSEHGWWGSENITIQEGNDVFKENYVTLPGTFNECYPTYLYQKIGESELKAYTRYQLRGYIEDSQDLEIYLIRYNAKHETLDVPGTESVWPLSVESPIGRCGEPNRCAPHFEWNPDLDCSCRDGEKCAHHSHHFSLDIDIGCTDLHENLGVWVVFKIKTQEGHARLGNLEFIEEKPLLGEALSRVKRAEKKWRDKREKLQLETKRVYTEAKEAVDALFVDSQYNRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPLPAGYVTKELEYFPETDKVWIEIGETEGTFIVDSIELLLMEE

SEQ ID NO: 151 - protein, 1235 aa, Bacillus thuringiensis
MNSNRKNENEIIDASFIPAVSNESVTISKEYAQTNQLQNNSIEDGLCIAEGEYIDPFVSASTVQTGISIAGRILGVLGVPFAGQLASFYSFIVGELWPKGRDQWEIFMEHVEQLVRQQITANARNTALARLQGLGDSFRAYQQSLEDWLENRNDARTRSVLYTQYIALELDFLNAMPLFAIREQEVPLLMVYAQAANLHLLLLRDASLYGREFGLTSQEIQRYYERQVERTRDYSDHCVQWYNTGLNNLRGTNAESWVRYNQFRRDLTLGVLDLVALFPSYDTRTYPINTSAQLTREVYTDAIGATGVNMASMNWYNNNAPSFSAIETAVIRSPHLLDFLEQLKIFSASSRWSNTRHMTYWRGHTIQSRPIRGALITSTHGNTNTSINPVTFQFPSRDVYRTESYAGVLLWGIYLEPIHGVPTVRFNFRNPQNTFERGTANYSQPYESPGLQLKDSETELPPETTERPNYESYSHRLSHIGIILQTRLNVPVYSWTHRSADRTNTISSDSITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVTLPGTYNECYPTYLYQKIGESELKAYTRYQLRGYIEDSQDLEIYLIRYNAKHETLDVPGTESVWPLSVESPIRRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPLPAGYVTKELEYFPETDKVWIEIGETEGTFIVDSIELLLMEE

SEQ ID NO: 152 - protein, 1256 aa, Bacillus thuringiensis PS46L
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNQEVPLLMVYAQAANLHLLLLRDASLFGSEWGTASSDVNQYYQEQIRYTEEYSNHCVQWYNTGLNNLRGTNAESWVRYNQFRRDLTLGVLDLVALFPSYDTRTYPINTSAQLTREVYTDAIGTVHPSQAFASTTWFNNNAPSFSAIEAAVIRPPHLLDFPEQLTIYSTLSRWSNTQFMNIWAGHRLESRPIAGSLNTSTQGSTNTSINPVTLQFTSRDIYRTESLAGLNIFITQPVNGVPWVRFNWRNPLNSLRGSLLYTIGYTGVGTQLQDSETELPPETTERPNYESYSHRLSHIGLISSSHVRALVYSWTHRSADRTNTIGPNRITQIPAVKGRFLFNGSVISGPGFTGGDVVRLNRNNGNIQNRGYIEVPIQFTSTSTRYRVRVRYASVTSIELNVNWGNSSIFTNTLPATAASLDNLQSGDFGYVEINNAFTSATGNIVGVRNFSANAEVIIDRFEFIPVTATFEAKYDLERAQKAVNALFTSTNPRRLKTDVTDYHIDQVSNLVVCLSDEFCLDEKRELFEKVKYAKRLSDERNLLQDPNFTFINGQPSFASIDGQSNFTSINELSNHGWWGSANVTIQEGNDVFKENYVTLPGTFNECYPNYLYQKIGESELKAYTRYQLRGYIEDSQDLEIYLIRYNAKHETLNVPGTESLWPLSVESPIGRCGEPNRCAPHFGWNPDLDCSCRDREKCAHHSHHFTLDIDVGCTDLQEDLGVWVVFKIKTQEGYARLGNLEFIEEKPLIGEALSRVKRAEKKWRDKREKLQVETKRVYIDAKEAVDALFVDSQYDRLQADTNIGMIHAADRLVHRIHEAYLPELPFIPGINVVIFEELENRISTAFSLYDARNVIKNGDFNNGLTCWNVKGHVEVQQLNNHRSVLVIPEWEAEVSQKVRVCPGRGYILRVTAYKEGYGEGCVTIHEVDNNTDQLKFSNCEKGQVYPGNTIACNDYNKNHGANACSSRNRGYDEFYGNTPADYSANQKEYGGAYTSHNHAYGESYESNSSIPADYAPVYEEEAYTHGRRGNSCEYNRGYTPLPAGYVTAELEYFPETDTVWVEIGETEGTFIVDNVELLLMEE

SEQ ID NO: 153 - protein, 1189 aa, Bacillus thuringiensis entomocidus 60.5
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPETRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSRIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTDRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 154 - protein, 181 aa, Bacillus thuringiensis E05-20a
LTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDN

SEQ ID NO: 155 - protein, 1044 aa, Bacillus thuringiensis C-33
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAQRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAY

SEQ ID NO: 156 - protein, 1191 aa, Bacillus thuringiensis LB-R-78
MENNIQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKVDAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGGALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 157 - protein, 823 aa, Bacillus thuringiensis aizawai 7.29
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSIPTLRLLQQPCQRHHFNLRGGEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIAYNAKHEIVNVPGTGSLWPLSAQSPIGKCGEPNRCAPHLEWNPDLDCSC

SEQ ID NO: 158 - protein, 1189 aa, Bacillus thuringiensis aizawai PS81I
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGQVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGLWVIFKIKTQDNHARLGNLEFLEEKPLLGEALARVKRAEKKWRDKREKLQLETNIVYKEAKESVDALFVNSQYDRLQVNTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 159 - protein, 1189 aa, Bacillus thuringiensis entomocidus HD110
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPETRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 160 - protein, 756 aa, Bacillus thuringiensis aizawai 7.29
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTR

SEQ ID NO: 161 - protein, 1189 aa, Bacillus thuringiensis AF-2
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGVTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISERPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYSSRNQGYDEAFGNNPSVPADYASVYEEKSYTDGRRENPCESNRGYGDYTPLPAGYVTKDLEYFPETDKVWIEIGETEGTFIVDSVELVLMEE

SEQ ID NO: 162 - protein, 1189 aa, Bacillus thuringiensis J8
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFRISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQPVGQLTREVYTDPLINFNPQLQSVAQLPTFNVMESSAIRNPHLFDILNNLTIFTDWFSVGRNFYWGGHRVISSLIGGGNITSPIYGREANQEPPRSFTFNGPVFRTLSNPTLRLLQQPWPAPPFNLRGVEGVEFSTPTNSFTYRGRGTVDSLTELPPEDNSVPPREGYSHRLCHATFVQRSGTPFLTTGVVFSWTHRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 163 - protein, 1189 aa, Bacillus thuringiensis c002; identical to SEQ ID NO: 162

SEQ ID NO: 164 - protein, 1189 aa, Bacillus thuringiensis G10-01A; identical to SEQ ID NO: 162

SEQ ID NO: 165 - protein, 1176 aa, Bacillus thuringiensis c001
MENNIQNQCVPYNCLSNPEEILLDGERISTGNSSIDISLSLVQLLVSNFVPGGGFLVGLLDFVWGIVGPSPWDAFLVQIEQLINERIAAYARSAAISNLEGLGNNFNIYVEAFKEWEADPDNPVTRTRVVDRFRILDGLLERDIPSFRIAGFEVPLLSVYAQAANLHLAILRDSSIFGARWGLTTINVNENYNRLIRHIDEYANHCADTYNRGLNNLPKSTYQDWITYNRLRRDLTLTVLDIAAFFPSYDNRRYPIQSVGQLTREIYTDPLITFNPQLQSVAQLPTFNVMESNAIRTPHLFDVLNNLTIFTDWFSVGRNFYWGGHRVISNRIGGGNITSPIYGREANQEPPRSFTFNGPVFRTLSNPTFRPLQQPWPAPPFNLRGVEGVEFSTPLNSFTYRGRGTVDSLTELPPEDNSVPPREGYSHRLCHATFVQRSGTPFLTTGPVFSWTHRSATDRNIIYPDVINQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQEAVNALFTSTNQLGLKTDVTDYHIDQVSNLVECLSDEFCLDEKRELSEKVKHAKRLSDERNLLQDRNFRSINGQLDRGWRGSTDITIQGGDDVFKENYVTLPGTFDECYPTYLYQKIDESKLKSYTRYELRGYIEDSQDLEIYLIRYNAKHEIVNVPGTGSLWPLSIENSIGPCGEPNRCAPHLEWNPNLDCSCRDGEKCAHHSHHFSLDIDVGCTDLNEDLGVWVIFKIKTQDGHARLGNLEFLEEKPLLGEALARVKRAEKKWRDKREKLEWETNIVYKEAKESVDALFVNSQYDRLQADTNIAMIHAADKRVHRIREAYLPELSVIPGVNAGIFEELEGRIFTAYSLYDARNVIKNGDFNNGLLCWNLKGHVDVEEQNNHRSVLVVPEWEAEVSQEVRVCPGRGYILRVTAYKEGYGEGCVTIHEIEDNTDELKFSNCVEEEVYPNNTVTCNDYTATQEEYGGAYTSRNHGYGKSYESNSSVQADYASVYEEKADTDGRRDNHCESNRGYGDYTPLPAGYVTKELEYFPETDKVWVEIGETEGTFIVDSVELLLMEE

SEQ ID NO: 166 - protein, 646 aa, Bacillus thuringiensis 087
MVMSVTVGGSTTGNQGFPSTMSANGALTSQSFRFAEFPVGISASGSQGASISISNNVGRQMFHLDRIEFLPVTSTFEEEYDLERAQEAVNALFTSTNQLGLKTDVTDYHIDQVSNLVECLSDEFCLDEKRELSEKVKHAKRLSDERNLLQDRNFRSINGQLGRGWRGSTDITIQGGDDVFKENYVTLPGTFDECYPTYLYQKIDESKLKSYTRYELRGYIEDSQDLEIYLIRYNAKHEIVNVPGTGSLWPLSIENSIGPCGEPNRCAPHLEWNPNLDCSCRDGEKCAHHSHHFSLDIDVGCTDLNEDLGVWVIFKIKTQDGHARLGNLEFLEEKPLLGEALARVKRAEKKWRDKREKLEWETNIVYKEAKESVDALFVNSQYDRLQADTNIAMIHAADKRVHRIREAYLPELSVIPGVNAGIFEELEGRIFTAYSLYDARNVIKNGDFNNGLLCWNLKGHVDVEEQNNHRSVLVVPEWEAEVSQEVRVCPGRGYILRVTAYKEGYGEGCVTIHEIEDNTDELKFSNCVEEEVYPNNTVTCNDYTATQEEYGGAYTSRNHGYGKSYESNSSVQADYASVYEEKADTDGRRDNHCESNRGYGDYTPLPAGYVTKELEYFPETDKVWVEIGETEGTFIVDSVELLLMEE

SEQ ID NO: 167 - protein, 244 aa, Bacillus thuringiensis TA476-1
TIQGGDDVFKENYVTLPGTFDECYPTYLYQKIDESKLKAYTRYQLRGYIGDSQDLEIYLIRYNAKHEIVNVPGTGSLWTLSVENSIGPCGEPNRCAPHLEWNPNLECSCREGEKCAHHSHHFSLDIDVGCTDLNEDLGVWAIFKIKTQDGHARLGNLEFLEEKPLVGEALARVKRAEKKWRDKREKLELETNIVYKEAKESVDALFVNSQYDRLQADTNIAMIHAADKRVHSIREAYLPELSII

SEQ ID NO: 168 - protein, 1165 aa, Bacillus thuringiensis aizawai HD68
MEINNQNQCVPYNCLSNPKEIILGEERLETGNTVADISLGLINFLYSNFVPGGGFIVGLLELIWGFIGPSQWDIFLAQIEQLISQRIEEFARNQAISRLEGLSNLYKVYVRAFSDWEKDPTNPALREEMRIQFNDMNSALITAIPLFRVQNYEVALLSVYVQAANLHLSILRDVSVFGERWGYDTATINNRYSDLTSLIHVYTNHCVDTYNQGLRRLEGRFLSDWIVYNRFRRQLTISVLDIVAFFPNYDIRTYPIQTATQLTREVYLDLPFINENLSPAASYPTFSAAESAIIRSPHLVDFLNSFTIYTDSLARYAYWGGHLVNSFRTGTTTNLIRSPLYGREGNTERPVTITASPSVPIFRTLSYITGLDNSNPVAGIEGVEFQNTISRSIYRKSGPIDSFSELPPQDASVSPAIGYSHRLCHATFLERISGPRIAGTVFSWTHRSASPTNEVSPSRITQIPWVKAHTLASGASVIKGPGFTGGDILTRNSMGELGTLRVTFTGRLPQSYYIRFRYASVANRSGTFRYSQPPSYGISFPKTMDAGEPLTSRSFAHTTLFTPITFSRAQEEFDLYIQSGVYIDRIEFIPVTATFEAEYDLERAQKVVNALFTSTNQLGLKTDVTDYHIDQVSNLVACLSDEFCLDEKRELSEKVKHAKRLSDERNLLQDPNFRGINRQPDRGWRGSTDITIQGGDDVFKENYVTLPGTFDECYPTYLYQKIDESKLKAYTRYQLRGYIEDSQDLEIYLIRYNAKHEIVNVPGTGSLWPLSVENQIGPCGEPNRCAPHLEWNPDLHCSCRDGEKCAHHSHHFSLDIDVGCTDLNEDLGVWVIFKIKTQDGHARLGNLEFLEEKPLLGEALARVKRAEKKWRDKRETLQLETTIVYKEAKESVDALFVNSQYDRLQADTNIAMIHAADKRVHRIREAYLPELSVIPGVNAAIFEELEERIFTAFSLYDARNIIKNGDFNNGLLCWNVKGHVEVEEQNNHRSVLVIPEWEAEVSQEVRVCPGRGYILRVTAYKEGYGEGCVTIHEIENNTDELKFNNCVEEEVYPNNTVTCINYTATQEEYEGTYTSRNRGYDEAYGNNPSVPADYASVYEEKSYTDRRRENPCESNRGYGDYTPLPAGYVTKELEYFPETDKVWIEIGETEGTFIVDSVELLLMEE

SEQ ID NO: 169 - protein, 1176 aa, Bacillus thuringiensis; identical to SEQ ID NO: 56

SEQ ID NO: 170 - protein, 1160 aa, Bacillus thuringiensis BTS00349A
MDINHQNQCIPYNCLSNPDAILLDAERLETGNTVADISLGLINFLYSNFVPGGGFIVGLLELIWGFVGPSQWEIFLAQIEQLISQRIEEFARNQAISRLEGLSNNYEIYTETFRAWEKDPSNPALREEMRTQFNVMNSALIAAIPLLRVRNYEVALLSVYVQAANLHLSVLRDVSVYGQRWGFDPATVNSRYSDLTRLIHVYTDHCVDTYNDGLKNLEGSRLSDWVVYNRFRRRLTISVLDIIAFFPNYDIEAYPIQTASQLTREVYLDLPFVNETLSPPASYPTFSAAESAIIRSPHLVDFLNSFTIYTDSLASYAYWGGHLVNSFRTGTTTNLIRSPLYGREGNTERPVTISASPSVPIFRTLSYFTGLNNNNPVAGIEGVEFQNTISRSIYRKSGPIDSFSELPPQDVSVSPAIGYSHRLCHATFLERISGPRIAGTVFSWTHRSASPINEVSPSRITQIPWVKAHTLASGASVIKGPGFTGGDILTRNSMGDLGALRVTFTGRLPQSYYIRFRYASVANRSGTFRYSQPPSYGISFPKTMDAGEALTSRSFAHTTLFTPITFSRAQEEFDLYIQSGVYIDRIEFIPVDATFESEINLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLTGTFDECYPTYLYQKIDESKLKAYTRYQLRGYIEDSQDLEIYLIRYNAKHEIVNVPGTGSLWPLSVQSPIGKCGEPNRCAPHLEWNPDLDCSCRDEEKCAHHSHHFSLDIDVGCTDLNEDLGVWVIFKIKTQDGHARLGNLEFLEEKPLVGEALARVKRAEKKWRDKREKLELETNIVYKEAKESVDALFVNSQYDQLQADTNIAMIHAADKRVHSIREAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPCEFNRGHTPLPAGYVTAELEYFPETDTVWVEIGETEGTFIVDSVELLLMEE

SEQ ID NO: 171 - protein, 1160 aa, Bacillus thuringiensis B-Pr-88
MDINHQNQCIPYNCLSNPDAILLDAERLETGNTVADISLGLINFLYSNFVPGGGFIVGLLELIWGFVGPSQWEIFLAQIEQLISQRIEEFARNQAISRLEGLSNNYEIYTETFRAWEKDPSNPALREEMRTQFNVMNSALIAAIPLLRVRNYEVALLSVYVQAANLHLSVLRDVSVYGQRWGFDPATVNSRYSDLTRLIHVYTDHCVDTYNDGLKNLEGSRLSDWVVYNRFRRRLTISVLDIIAFFPNYDIEAYPIQTASQLTREVYLDLPFVNETLSPPASYPTFSAAESAIIRSPHLVDFLNSFTIYTDSLASYAYWGGHLVNSFRTGTTTNLIRSPLYGREGNTERPVTISASPSVPIFRTLSYFTGLNNNNPVAGIEGVEFQNTISRSIYRKSGPIDSFSELPPQDVSVSPAIGYSHRLCHATFLERISGPRIAGTVFSWTHRSASPINEVSPSRITQIPWVKAHTLASGASVIKGPGFTGGDILTRNSMGDLGALRVTFTGRLPQSYYIRFRYASVANRSGTFRYSQPPSYGISFPKTMDAGEALTSRSFAHTTLFTPITFSRAQEEFDLYIQSGVYIDRIEFIPVDATFESEINLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLTGTFDECYPTYLYQKIDESKLKAYTRYQLRGYIEDSQDLEIYLIRYNAKHEIVNVPGTGSLWPLSVQSPIGKCGEPNRCAPHLEWNPDLDCSCRDEEKCAHHSHHFSLDIDVGCTDLNEDLGVWVIFKIKTQDGHARLGNLEFLEEKPLVGEALARVKRAEKKWRDKREKLELETNIVYKEAKESVDALFVNSQYDQLQADTNIAMIHAADKRVHSIREAYLPELSVIPGVNAGIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPSEFNRGHTPLPAGYVTAELEYFPETDTVWVEIGETEGTFIVDSVELLLMEE

SEQ ID NO: 172 - protein, 1173 aa, Bacillus thuringiensis JC291
MEIINNQNQCVPYNCLSNPENEILDIESLSSRSREQVAEISLGLTRFLLESLLPGASFGFALFDIIWGVIGPDQWNLFLAQIEQLIDQRIEAHVRNQAISRLEGLGDSYEVYIESLREWEGSPNNEGLQQDVRNRFSNTDNALITGYLFLREQGFEIPLLSVYVQAANLHLSILRDVSVFGERWGYDTATINNRYSDLTSLIHVYTNHCVDTYNQGLRRLEGRFLTDWIVYNRFRRQFTISVLDIVAFFPNYDIRTYPIHTATQLTREIYLDLPFINENLSPAASYPTFSAAESAIIRSPHLVDFLNSFTIYTDSLARYAYWGGHLVNCFRTGTTTNLIRSPLYGREGNTERPVTITASPSVPIFRTLSYITGLDNSNPVAGIEGVEFQNTISRSIYRKSGPIDSFNELPPQDASVSPSIGYSHRLCHATFLERISGPRIAGVVFPWTHRSASPTNEVSSSRKTQIPWVKAHTLASGASVIKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLPGTFDECYPTYLYQKIDESKLKAYTRYQLRGYIEDSQDLEIYLIRYNAKHEIVNVPGTGSLWPLSVENQIGPCGEPNRCAPHLEWNPDLHCSCRDGENVPIIPIISPWDIDVGCTDLNEDLGVWVIFKIKTQDGHARLGNLEFLEEKPLVGEALARVKRAEKKWRDKREKLELETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFNNCVEEEVYPNNTVTCINYTATQEEYEGTYTSRNRGYDEAYGNNPSVPADYASVYEEKSYTDRRRENPCESNRGYGDYTPLPAGYVTKELEYFPETDKVWIEIGETEGTFIVDSVELLLMEE

SEQ ID NO: 173 - protein, 1171 aa, Bacillus thuringiensis kenyae 4F1
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEENPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYFPETDKVWIEIGETEGTFIVDSVELLLMEE

SEQ ID NO: 174 - protein, 1171 aa, Bacillus thuringiensis BR64
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVAIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYLPETDKVWIEIGETEGTFIVDSVELLLMEE

SEQ ID NO: 175 - protein, 1171 aa, Bacillus thuringiensis kenyae; identical to SEQ ID NO: 173

SEQ ID NO: 176 - protein, 1171 aa, Bacillus thuringiensis kenyae PS81F
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYFPETDKVWIEIGETEGTFIVDSVELLLMEE

SEQ ID NO: 177 - protein, 1171 aa, Bacillus thuringiensis kenyae LBIT-147
MEIVNNQNQCVPYNCLNNPENEILDIERSNSTVATNIALEISRLLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGNSQNAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKELEYFPETDKVWIEIGETEGTFIVDSVELLLMEE

SEQ ID NO: 178 - protein, 1171 aa, Bacillus thuringiensis YBT-032; identical to SEQ ID NO: 176

SEQ ID NO: 179 - protein, 1171 aa, Bacillus thuringiensis JC190; identical to SEQ ID NO: 176

SEQ ID NO: 180 - protein, 1171 aa, Bacillus thuringiensis HZM2
MEIVNNQNQCVPYNCLNNPENEILDIERSNSTVATNIALEISRPLASATPIGGILLGLFDAIWGSIGPSQWDLFLEQIELLIDQKIEEFARNQAISRLEGISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILADATFEEEYDLERAQKAVNALFTSTNQLGLKTDVTDYHIDQVSNLVECLSDEFCLDEKRELSEKVKHAKRLSDERNLLQDPNFRGINRQPDRGWRGSTDITIQGGDDVFKENYVTLPGTFDECYPTYLYQKIDESKLKAYTRYELRGYIEDSQDLEIYLIRYNAKHETVNVPGTGSLWPLSAQSPIGKCGEPNRCAPHLEWNPNLDCSCRDGEKCAHHSHHFSLDIDVGCTDLNEDLGVWVIFKIKTQDGYARLGNLEFLEEKPLLGEALARVKRAEKKWRDKCEKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRGCPGRGYILRVTAYKEGYGEGCVTIHEIEDNTDELKFSNCVEEEVYPNNTVTCNNYTATQEEHEGTYTSRNRGYDEAYESNSSVHASVYEEKSYTDRRRENPCESNRGYGDYTPLPAGYVTKESEYFPETDKVWIEIGETEGTFIVDSVELLLMEE

SEQ ID NO: 181 - protein, 1174 aa, Bacillus thuringiensis aizawai PS81A2
MENNIENQCIPYNCLNNPEVEILGIERSNSNVAAEIGLGLSRLLVSRIPLGDFILGLFDVIWGAIGPSQWDIFLEQIELLIGQRIEEFARNQAISRLQGLSNLYRIYTNAFKNWEVDPTNPALREEMRIQFNDMNSALTTAIPLFSVQGYEIPLLSVYVQAANLHLSVLRDVSVFGQRWGFDVATINSRYNDLTRLIGEYTDYAVRWYNTGLNRLPRNEGVRGWARFNRFRRELTISVLDIISFFQNYDSRLYPIPTIYQLTREVYTDPVINITDYRVTPSFESIENSAIRSPHLMDFLNNIIIDTDLIRGVHYWAGHRVTSHFTGSSQVISSPQYGITANAEPSRTIAPSTFPGLNLFYRTLSDPFFRRSDNIMPTLGINVVQGVGFIQPNNGEVLYRRRGTVDSLDELPIDGENSLVGYSHRLSHVTLTRSLYNTNITSLPTFVWTHHSATDRNIIYPDVITQIPLVKSFSLTSGTSVVRGPGFTGGDIIRTNVNGNVLSMSLNFSNTSLQRYRVRVRYAASQTMVMRVNVGGSTTFDQGFPSTMSANGSLTSQSFRFAEFPVGISTSGSQTAGISISNNPGRQTFHLDRIEFIPVDATFEAEYDLERAQKAVNSLFTSSNQIELKTDVTDYHIDQVSNLVDCLSDEFCLDEKRELSEKVKHAKRLSDERNLLQDPNFRGINRQPDRGWRGSTDITIQGGDDVFKENYVTLPGTFDECYPTYLYQKIDESKLKAYNRYQLRGYIEDSQDLEIYLIRYNAKHETVNVPGTGSLWPLSVESPIGRCGEPNRCVPHLEWNPDLDCSCRDGEKCAHHSHHFSLDIDVGCTDLQEDLGVWVVFKIKTQEGYARLGNLEFIEEKPLIGEALSRVKRAEKKWRDKREKLQLETKRVYTEAKEAVDALFVDSQYDRLQADTNIGMIHAADRLVHQIHEAYLPELPFIPGINVVIFEELENRISTALSLYDARNVIKNGDFNNGLSCWNVKGHVDVVEQNNHRSVLVVPEWEAEVSQTIRVCPGRGYILRVTAYKEGYGEGCVTIHEIENNTDELKFKNCEEEEVYPTDTGTCNDYTAHQGTAGSTDSCNSRNIRYEDAYEMNTTASVNYKPTYEEERYTDVQGDNHCEYDRGYVNYRPVPAGYVTKELEYFPETDKVWIEIGETEGKFIVDNVELLLMEE

SEQ ID NO: 182 - protein, 1174 aa, Bacillus thuringiensis aizawai EG6346
MENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQKAVNALFTSINQIGIKTDVTDYHIDQVSNLVDCLSDEFCLDEKRELSEKVKHAKRLSDERNLLQDPNFKGINRQLDRGWRGSTDITIQRGDDVFKENYVTLPGTFDECYPTYLYQKIDESKLKPYTRYQLRGYIEDSQDLEIYLIRYNAKHETVNVLGTGSLWPLSVQSPIRKCGEPNRCAPHLEWNPDLDCSCRDGEKCAHHSHHFSLDIDVGCTDLNEDLDVWVIFKIKTQDGHARLGNLEFLEEKPLVGEALARVKRAEKKWRDKREKLELETNIVYKEAKESVDALFVNSQYDQLQADTNIAMIHAADKRVHRIREAYLPELSVIPGVNVDIFEELKGRIFTAFFLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTANQEEYGGAYTSRNRGYDETYGSNSSVPADYASVYEEKSYTDGRRDNPCESNRGYGDYTPLPAGYVTKELEYFPETDKVWIEIGETEGTFIVDSVELLLMEE

SEQ ID NO: 183 - protein, 1174 aa, Bacillus thuringiensis aizawai PS81I; identical to SEQ ID NO: 182

SEQ ID NO: 184 - protein, 1174 aa, Bacillus thuringiensis BTS00349A
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGIFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVIPEWEAEVSQKVRVCPGRGYILRVTAYKEGYGEGCVTIHEIEDNTDELKFSNCVEEGYPNNTVTCNEYTMNQGVGECTDACNVRNRGYEDAYGHNPSTPVHYTTPYEEETYTDERRENPCEANKGYVNYTPLPVGYVTKELEYFPETDTVWIEIGETEGTFIVDSVELLLMEE

SEQ ID NO: 185 - protein, 1168 aa, Bacillus thuringiensis morrisoni INA67
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGIFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVIPEWEAEVSQKVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPCEFNRGHTPLPAGYVTAELEYFPETDTVWVEIGETEGTFIVDSVELLLMEE

SEQ ID NO: 186 - protein, 1169 aa, Bacillus thuringiensis morrisoni
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGVFNPGGAIWIADEDPRPFYRTLSDPVFVRGGFGNPHYVLGLRGVGFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVVPEWEAEVSQEVRVCPGRGYILRVTAYKEGYGEGCVTIHEVDNNTDELKFSSNCEKEQVYPGNTVACNDYNKNHGANACSSRNGGYDESYESNSSIPADYAPVYEEEAYTDGQRGNPCEFNRGHTPLPAGYVTAELEYFPETDTVWVEIGETEGTFIVDSVELLLMEE

SEQ ID NO: 187 - protein, 1174 aa, Bacillus thuringiensis B-Pr-88; identical to SEQ ID NO: 184

SEQ ID NO: 188 - protein, 1168 aa, Bacillus thuringiensis 012
MENNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSCEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGVFNPGGAIWIADEDPRPFYRTLSDPVFVRGGFGNPHYVLGLRGVGFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVVPEWEAEVSQEVRVCPGRGYILRVTAYKEGYGEGCVTIHEVDNNTDELKFSSCEKEQVNPGNTVACNDYNKNHGANACSSRSRGYDESYESNSSIPADYAPVYEEEAYTDGQRGNPCEFNRGHTPLPAGYVTAELEYFPETDTVWVEIGETEGTFIVDSVELLLMEE

SEQ ID NO: 189 - protein, 1174 aa, Bacillus thuringiensis 087
MENNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDAGAYPIQTSSQLTREIYTSSVIEDSPVSANIPNGFNRAEFGVRPPHLMDFMNSLFVTAETVRSQTVWGGHLVSSRNTAGNPINFPIYGIFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGGNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGISRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALARVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVIPEWEAEVSQKVRVCPGRGYILRVTAYKEGYGEGSVTIHEIEDNTDELKFSNCVEEGYPNNTVTCNEYTMNQGVGECTDACNVRNRGYEDAYGHNPSTPVHYTTPYEEETYTDERRENPCEANKGYVNYTPLPVGYVTKELEYFPETDKVWVEIGETEGTFIVDSVELLLMEE

SEQ ID NO: 190 - protein, 1166 aa, Bacillus thuringiensis BTS0349A
MEISDQNQYIPYNCLNNPESEIFNARNSNFGLVSQVSSGLTRFLLEAAVPEAGFALGLFDIIWGALGVDQWSLFLRQIEQLIRQEITELERNRATAILTGLSSSYNLYVEALREWENDPNNPASQERVRTRFRLTDDAIVTGLPTLAIRNLEVVNLSVYTQAANLHLSLLRDAVYFGERWGLTQANIEDLYTRLTSNIQEYSDHCARWYNQGLNEIGGISRRYLDFQRDLTISVLDIVALFPNYDIRTYPIPTQSQLTREIYTSPVVAGNINFGLSIANVLRAPHLMDFIDRIVIYTNSVRSTPYWAGHEVISRRTGQGQGNEIRFPLYGVAANAEPPVTIRPTGFTDEQRQWYRARSRVVSFRSSGQDFSLVDAVGFLTIFSAVSIYRNGFGFNTDTIDEIPIEGTDPFTGYSHRLCHVGFLASSPFISQYARAPIFSWTHRSATLTNTIAPDVITQIPLVKAFNLHSGATIVKGPGFTGGDILRRTNVGSFGDMRVNITAPLSQRYRVRIRYASTTDLQFYTNINGTTINIGNFSSTMDSGDDLQYGRFRVAGFTTPFTFSDANSTFTIGAFGFSPNNEVYIDRIEFVPAEVTFEAEYDLEKAQKAVNALFTSSNQIGLKTDVTDYHIDKVSNLVECLSDEFCLDEKRELSEKVKHAKRLSDERNLLQDPNFRGINRQPDRGWRGSTDITIQGGDDVFKENYVTLPGTFDGCYPTYLYQKIDESKLKVYTRYQLRGYIEDSQDLEIYLIRYNAKHETVNVPGTGSLWPLSAQSPIGKCGEPNRCAPHLEWNPDLDCSCRNGEKCAHHSHHFSLDIDVGCTDLNEDLGVWVIFKIKTQDGHARLGNLEFLEEKPLLGEALARVKRAEKKWRDKREKLELETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTANQEEYKGAYTSHNRGYDEAYGNNPSVPADYTPVYEEKAYTDGRRENPCESNRGYGDYTPLPAGYVTKELEYFPETDKVWIEIGETEGTFIVESVELLLMEE

SEQ ID NO: 191 - protein, 1173 aa, Bacillus thuringiensis wuhanensis
MEISDQNQYIPYNCLNNPESEIFNARNSNFGLVSQVSSGLTRFLLEAAVPEAGFALGLFDIIWGALGVDQWSLFLRQIEQLIRQEITELERNRATAILIGLSSSYNLYVEALREWENDPNNPASQERVRTRFRLTDDAIVTGLPTLAIRNLEVVNLSVYTQAANLHLSLLRDAVYFGERWGLTQANIEDLYTRLTSNIQEYSDHCARWYNQGLNEIGGISRRYLDFQRDLTISVLDIVAPFSPNYDIRTYPIPTQSQLTREIYTSPVVAGNINFGLSIANVLRAPHLMDFIDRIVIYTNSVRSTPYWAGHEVISRRTGQAQGNEIRFPLYGVAANAEPPVTIRPTGFTDEQRQWYRARSLLSRFRSSGQDFSLVDAVAFLTIFSAVSIYRNGFGFNTDTIDEIPIEGTDPFTGYSHRLCHVGFLASSPFISQYARAPIFSWTHRSATLTNTIAPDVITQIPLVKAFNLHSGATIVKGPGFTGGDILRRTNVRSFRDMRVNITAPLSQRYRVRIRYASTTDLQFYTNINGTTINIGNFSSTMDSGDDLQYGRFRVAGFTTPFTFSRCKQTFHNRSFWFSPKLTEVYIDRIEFVPAEVTFEAEYDLEKAQKAVNALFTSSNQIGLKTDVTDYHIDKVSNLVECLSDEFCLDEKRELSEKVKHAKRLSDERNLLQDPNFRGINRQPDRGWRGSTDITIQGGDDVFKENYVTLPGTFDGCYPTYLYQKIDESKLKAYTRYQLRGYIEDSQDLEIYLIRYNAKHETVNVPGTGSLWPLSAQSPIGKCGEPNRCAPHLEWNPYLDCSCRNGKKCAHHSHHFSLDIDVGCTDLNEDLGVWVIFKIKTQDGHARLGNLEFLEEKPLLGEALARVKRAEKKWRDKREKLELETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHESRTIQRTEIQQLLEEEVYPNNTVTCNDYTANQEEYKGAYTSHNRGYDEAYGNNPSVPADYTPVYEEKAYTDGRRDNPCESNRGYGDYTPLPAGYVSKELEYFPETDKVWIEIGETEGTFIVESVNYSLWRNRIRFKM

SEQ ID NO: 192 - protein, 1169 aa, Bacillus thuringiensis wuhanensis HD525
MEINNQNQCVPYNCLNNPESEILNVAIFSSEQVAEIHLKITRLILENFLPGGSFAFGLFDLIWGIFNEDQWSAFLRQVEELINQRITEFARGQAIQRLVGFGRSYDEYILALKEWENDPDNPASKERVRTRFRTTDDALLTGVPLMAIPGFELATLSVYAQSANLHLALLRDAVFFGERWGLTQTNINDLYSRLKNSIRDYTNHCVRFYNIGLGNLNVIRPEYYRFQRELTISVLDLVALFPNYDIRTYPIPTKSQLTREIYTDPIISPGAQAGYTLQDVLREPHLMDFLNRLIIYTGEYRGIRHWAGHEVESSRTGMMTNIRFPLYGTAATAEPTRFITPSTFPGLNLFYRTLSAPIFRDEPGANIIIRYRTSLVEGVGFIQPNNGEQLYRVRGTLDSLDQLPLEGESSLTEYSHRLCHVRFAQSLRNAEPLDYARVPMFSWTHRSATPTNTIDPDVITQIPLVKAFNLHSGATVVRGPGFTGGDILRRTNAGNFGDMRVNITAPLSQRYRVRIRYASTANLQFHTSINGRAINQANFPATMNSGENLQSGSFRVAGFTTPFTFSDALSTFTIGAFSFSSNNEVYIDGIEFVPAEVTFATESDQDRAQKAVNALFTSSNQIGLKTDVTNYHIDQVSNLVECLSDEFCLDEKRELSEKVKHAKRLCDERNLLQDPNFRGINREPDRGWRGSTDITIQRGDDVFKENYVTLPGTFDECYPTYLYQKIDESKLKAYTRYELRGYIEDSQDLEIYLIRYNAKHETVNVPGTGSLWPLSAQSPIGKCGEPNRCATHLEWNPDLDCSCRDGEKCAHHSHHFSLDIDVGCTDLNEDLGVWVIFKIKTQDGHARLGNLEFLEEKPLLGEALARVKRAEKKWRDKREKLELETNIVYKEAKKSVDALFVNSQYDRLQADTNIAIIHAADKRVHSIREAYLPELSVIPGVNAAIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEIYPNNTVTCNDYTATQEEYEGTYTSRNRGYDGAYESNSSVPADYASAYEEKAYTDGRRDNTCESNRGYGDYTPLPAGYVTKELEYFPETDKVWIEIGETEGTFIVDSVELLLMEE

SEQ ID NO: 193 - protein, 1169 aa, Bacillus thuringiensis B-Pr-88
MEINNQNQCVPYNCLNNPESEILNVAIFSSEQVAEIHLKITRLILENFLPGGSFAFGLFDLIWGIFNEDQWSAFLRQVEELINQRITEFARGQAIQRLVGFGRSYDEYILALKEWENDPDNPASKERVRTRFRTTDDALLTGVPLMAIPGFELATLSVYAQSANLHLALLRDAVFFGERWGLTQTNINDLYSRLKNSIRDYTNHCVRFYNIGLGNLNVIRPEYYRFQRELTISVLDLVALFPNYDIRTYPIPTKSQLTREIYTDPIISPGAQAGYTLQDVLREPHLMDFLNRLIIYTGEYRGIRHWAGHEVESSRTGMMTNIRFPLYGTAATAEPTRFITPSTFPGLNLFYRTLSAPIFRDEPGANIIIRYRTSLVEGVGFIQPNNGEQLYRVRGTLDSLDQLPLEGESSLTEYSHRLCHVRFAQSLRNAEPLDYARVPMFSWTHRSATPTNTIDPDVITQIPLVKAFNLHSGATVVRGPGFTGGDILRRTNAGNFGDMRVNITAPLSQRYRVRIRYASTANLQFHTSINGRAINQANFPATMNSGENLQSGSFRVAGFTTPFTFSDALSTFTIGAFSFSSNNEVYIDRIEFVPAEVTFATESDQDRAQKAVNALFTSSNQIGLKTDVTNYHIDQVSNLVECLSDEFCLDEKRELSEKVKHAKRLCDERNLLQDPNFRGINREPDRGWRGSTDITIQRGDDVFKENYVTLPGTFDECYPTYLYQKIDESKLKAYTRYELRGYIEDSQDLEIYLIRYNAKHETVNVPGTGSLWPLSAQSPIGKCGEPNRCATHLEWNPDLDCSCRDGEKCAHHSHHFSLDIDVGCTDLNEDLGVWVIFKIKTQDGHARLGNLEFLEEKPLVGEALARVKRAEKKWRDKREKLELETNIVYKEAKKSVDALFVNSQYDRLQADTNIAIIHAADKRVHSIREAYLPELSVIPGVNAAIFEELEGRIFTAYSLYDARNVIKNGDFNNGLSCWNVKGHVDVEEQNNHRSVLVVPEWEAEVSQEVRVCPGRGYILRVTAYKEGYGEGCVTIHEIEDNTDELKFSNCVEEEIYPNNTVTCNDYTATQEEYEGTYTSRNRGYDGAYESNSSVPADYASAYEEKAYTDGRRDNTCESNRGYGDYTPLPAGYVTKELEYFPETDKVWIEIGETEGTFIVDSVELLLMEE

SEQ ID NO: 194 - protein, 1167 aa, Bacillus thuringiensis
MERNNQDQCIPYNCLNNPEIEILDVENFNLELVSQVSVGLTRFLLESAVPGAGFALGLFDIIWGALGVDQWSLFLAQIEQLINERITTVERNRAIQTLSGLSSSYEVYIEALREWENNPDNPASQERVRTRFRTTDDALITAIPNLAIPDFEIATLSVYVQAANLHLSLLRDAVYFGERWGLTQVNIEDLYTRLTRNIHIYSDHCARWYNQGLNNIGATNTRYLEFQRELTLSVLDIVALFPNYDIRTYSIPTQSQLTREIYTDIIAAPNASNLIVGTQGLVRAPHLMDFLVRLNIYTGLARNIRHWAGHEVISRRTGGVDLNTIQSPLYGTAATTESPRLIIPFNEDSYLGGFIYRTLSSPIYVPPSGISSQRTSLVEGVGFQTPNNSILQYRQRGTLDSLEQVPLQEEGRPGGFGASHRLCHATFAQSPIGTNYYIRAPLFSWTHLSATLTNEVRVSRITQLPMVKAHTLHAGATVVRGPGFTGGDILRRTTSGSFGDMRITNFSSSSSRYRVRIRYASTTDLQFFLNVGGTPVNVADFPKTIDRGENLEYGSFRTAGFTTPFSFVSSTNNFTLGVQSVSSGNEIFVDRIEFVPADATFEAEYDLERAQEAVNALFTSTNQRGLKTDVTDYHIDQVSNLVDCLSDEFCLDEKRELSEKIKHAKRLSDERNLLQDSNFRGINRQPDRGWRGSTDITIQGGNDVFKENYVTLPGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 195 - protein, 1172 aa, Bacillus thuringiensis BTS02069AA
MEIINNQNQYVPYNCLSNPENEILDIESLSSRSREQVAEISLGLTRFLLESLLPGASFGFALFDIIWGVIGPDQWNLFLAQIEQLIDQRIEAHVRNQAISRLEGLGDSYEVYIESLREWEASPNNEALQQDVRNRFSNTDNALITAIPILREQGFEIPLLSVYVQAANLHLSLLRDAVYFGQRWGLDTVTVNNHYNRLINLINTYSDHCAQWFNRGLDNFGGVSARYLDFQREVTISVLDIVALFPNYDIRTYPISTQSQLTREIYTSPVAEPGASLNANLQNILREPHLMDFLTRLVIYTGVQSGIYHWAGHEISSRTTGNLSSNIQFPLYGTAASADRAFNMNIHHSETIYRTLSAPIYSVSGGISPNRTRVVEGVRFLIARDNNLDSLPFLYRKEGTLDSFTELPPEDESTPPYIGYSHRLCHARFARSPVILEPSNFARLPVFSWTHRSASPTNEVSPSRITQIPWVKAHTLASGASVIKGPGFTGGDIMTRNNINLGDLGTLRVTVTGRLPQSYYIRLRYASVANSSGVFRHLPQPSYGISFPRTMGTDEPLTSRSFALTTLFTPITLTRAQEEFNLTIPRGVYIDRIEFVPVDATFEAGYDLERAQKAVNALFTSTNQRGLKTDITDYHIDQVSNLVECLSDEFCLDEKRELSEKVKHAKRLSDGRNLLQDRNFISINGLLDRGWRGSTDITIQGSDDVFKENYVTLPGTFDECYPTYLYQKIDESKLKAYTRYQLRGYIEDSQDLEIYLIRYNAKHEIVNVPGTGSLWPLSVENSIGPCGESNRCAPHLEWNPNLDCSCRDGEKCAHHSHHFSLDIDVGCTDLNEDLGVWVIFKIKTQDGHARIGNLEFLEEKPLVGEALARVKRAEKKWRDKRKKLEFETNIVYKEAKESVDALFVNSQYDKLKADTNIAMIHAADKRVHRIREAYLPELSVIPGVNADIFEELEGRIFTAYSLYDARNVIKNGDFNNGLLCWNVKGHVDVEEQNNHRSVLVVPEWEAEVSQEVRVCPGRGYILRVTAYKEGYGEGCVTIHEIEDNTDELKFSNCVEEEVYPSNTVTCNDYTANQEEYEGTYTSRNQGYDEAYESNSSVPANYASVYEEKAYTDGRRENSCEFNRGYRDYTPLPAGYVTKELEYFPGTAKVWIEIGETEGTFIVDSVELLLMEE

SEQ ID NO: 196 - protein, 1155 aa, Bacillus thuringiensis morrisoni BF190
MEVNHQNECVPYNCLKNPKIEMLDIEGISSRSREQVAEISLGLTRFLLESLLPGASFGFGLFDIIWGVIGPDQWSLFLTQIEQLIDQRIEAHVRNQAISRLEGLGDSYEVYIESLREWEASPNNESLQQDVRNRFSNTDNALITAIPILREQGFEIPLLTVYVQAANLHLSLLRDAVYFGQRWGLDTATVNNHYNRLINLINTYSDHCAQWFNRGLDNFGVVTARYLDFQREVTISVLDIVALFPNYDIRTYPIQTLSQLTREIYTSPVAEPGASLNVDLRNILREPHLMDFLTRLVIYTGVQGGIYHWAGHEISSRTTGNLSSNIQFPLYGTSANADRPFNLAIHYSETIYRTLSAPIYSVSGGISPNRTRAVEGVRFLTARDNNLNSLPFLYRKEGSLDSFTELPPEDENEPPYIGYSHRLCHARFARSSVVLEPSNFARIPVFSWTHRSAGPTNEVSSSRITQIPWVKAHTLDSGAFVIKGPGFTGGDILTRPNLGTLGALRVTLTGQLPQTYNIRIRYASIANRGGTLIFSQPPSYGLTFPKTMDIDEPLTSRSFARTTLFTPITFTQAQAELNLTIQQGVYIDRIEFIPVNATFEAEYDLERAQEAVNALFTSSNQLGLKTDLTDYHIDQVSNLVDCLSDEFCIDEKRELSEKVKHAKRLSDERNLLQDSNFRGINRQPDRGWRGSTDITIQGGNDVFKENYVTLPGTFDECYPTYLYQKIDESKLKAYTRYQLRGYIEDSQDLEIYLIRYNAKHETVNVPGTGSLWPLSVESPIGKCGEPNRCVPQLEWNSNLDCSCRDGEKCAHHSHHFSLDIDVGCTDLNEDLGVWVIFKIKTQDGHARLGNLEFLEEKPLLGEALARVKRAEKKWRDKRETLQLETNIVYKEAKESVDALFANSQYNRLQADTNIAMIHAADKRVHRIREAYLPELSVIPGVNAGIFEELEGRIFTAFSLYDARNVIKNSDFNNGLSCWNVKGHVDIEEQNNHRSVLVVPEWEAEVSQKVHVCPGRGYILRVTAYKEGYGEGCVTIHEIEDHTDELKFRNCEEDEVYPNNTRTCNAYPADQEGYEGACTSRNRGYDEVYGNTPSLPADYAPIYEENAYTDGRRGNPCESSRGYGDYTPLPAGYETKELEYFPETDTVWPRNRYSVD

SEQ ID NO: 197 - protein, 140 aa, Bacillus thuringiensis JC291
QCVPYNCLSNPENEILDIESLSSRSREQVAEISLGLTRFLLESLLPGASFGFALFDIIWGVIGPDQWNLFLAQIEQLIDQRIEAHVRNQAISRLEGLGDSYEVYIESLREWEGSPNNEGLQQDVRNRFSNTDNALITGYL

SEQ ID NO: 198 - protein, 719 aa, Bacillus thuringiensis kurstaki
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSYHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 199 - protein, 719 aa, Bacillus thuringiensis thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 200 - protein, 719 aa, Bacillus thuringiensis kurstaki BNS3
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYANELHIERNM

SEQ ID NO: 201 - protein, 719 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVRSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 202 - protein, 719 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVNAFNLSSGAAVVRGPGFTGGDILRRTNTGTFGDIRVNINPPFAQRYRVRIRYASTTDLQFHTSISGKAINQGNFSATMNRGEDLDYKTSRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 203 - protein, 719 aa, Bacillus thuringiensis; identical to SEQ ID NO: 199

SEQ ID NO: 204 - protein, 719 aa, Bacillus thuringiensis E-1B
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMVVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYVNEKAQEKVTALFTSTNPRGLKTDVKDYHIDQVSNLVESLSDEFYLDEKRELFEIVKYANELHIERNM

SEQ ID NO: 205 - protein, 719 aa, Bacillus thuringiensis E-1A
MKLKNQDKHQSFSSNAKLDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYGKGLHIERNM

SEQ ID NO: 206 - protein, 719 aa, Bacillus thuringiensis MX2
MKLKNPDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAVYDFEKAQEKVTALFTSTNPRGLKTDVKDHHIDQVSNLVESLSDEFYLDEKRELFEIVKYAKQLHIERNM

SEQ ID NO: 207 - protein, 705 aa, Bacillus thuringiensis MX9
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVKNRNNTRARSVVKNQYIALELMFVQKLPSFAVSGEEVPLLPIYAQAANLHLLLLRDASIFGKEWGLSASEISTFYNRQVERTRDYSDHCVKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLPSGAAVVRGPGFTGGDILRRTNTGTFGDIRVNINPPFAQRYRVRIRYASTTDVQFHTSINGKAINQGNFSATMNRGEDLDYKTFRTVGFTTPFSLSDVQSTFTIGAWNFSSGNEVYIDRIEFVPVEVTYEAEHDFEKAQEEVTALFTSTNPGGLKTNVTEYHIDQVSNLVESLSMNSISMKRENYSR

SEQ ID NO: 208 - protein, 719 aa, Bacillus thuringiensis kurstaki; identical to SEQ ID NO: 199

SEQ ID NO: 209 - protein, 719 aa, Bacillus thuringiensis kurstaki HD1
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSYHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYANELHIERNM

SEQ ID NO: 210 - protein, 719 aa, Bacillus thuringiensis AB88
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYVGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 211 - protein, 719 aa, Bacillus thuringiensis 61
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVRSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYANELHIERNM

SEQ ID NO: 212 - protein, 719 aa, Bacillus thuringiensis kurstaki S101
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNIKPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 213 - protein, 719 aa, Bacillus thuringiensis
MKLKNPDKHQSFSSNAKVDKISTDSLKNETDIELQNINHEDCLKISEYENVEPFVSASTIQTGISIAGKILGTLGVPFAGQVASLYSFILGELWPKGKNQWEIFMEHVEEIINQKISTYARNKALTDLKGLGDALAVYHESLESWVGNRKNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRKDMTLMVLDLVALFPSYDTLVYPIKTTSQLTREVYTDAIGTVHPNASFASTTWYNNNAPSFSTIESAVVRNPHLLDFLEQVTIYSLLSRWSNTQYMNMWGGHRLEFRTIGGMLNTSTQGSTNTSINPVTLPFTSRDVYRTESLAGLNLFLTQPVNGVPRVDFHWKFVTHPIASDNFYYPGYAGIGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDIQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPGGLKTNVTEYHIDQVSNLVESLSNEFYLDEKRELFEIVKYAKQLHTGRNM

SEQ ID NO: 214 - protein, 719 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTHPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 215 - protein, 720 aa, Bacillus thuringiensis Ly30
MKLKNPDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNMP

SEQ ID NO: 216 - protein, 719 aa, Bacillus thuringiensis entomocidus BP465
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVENRNNTRARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESLAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTIGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 217 - protein, 719 aa, Bacillus thuringiensis PP61
MKLKNPDKHQSLSSNAKVDKIATDSLKNETDIELKNMNNEDYLRMSEHESIDPFVRASTIQTGIGIAGKILGTLGVPFAGQIASLYSFILGELWPKGKSQWEIFMEHVEEIINQKILTYARNKAPSDLRGLGDALAVYHESLESWVENRNNTRARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGKFSATMNRGEDLDYKTFRTVGFTTPFGFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 218 - protein, 719 aa, Bacillus thuringiensis GS8
MKLKNQDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVENRNNTRARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 219 - protein, 719 aa, Bacillus thuringiensis BF-4
MKLKNPDKHQSLSSNAKVDKIATDSLKNETDIELKNINHEDFLRMSEHESIDPFVSASTIQTGIGIAGKILGTLGVPFAGQIASLYSFILGELWPKGKSQWEIFMEHVEELIDQKISTYARNIALADLKGLGDALAVYHESLESWIKNRNNARARSVVKNQYIALELMFVQKLPSFAVSGEEVPLLPIYAQAANLHLLLLRDASIFGKEWGLSASEISTFYNRQVERTRDYSDHCIKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 220 - protein, 702 aa, Bacillus thuringiensis LB52
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVKNRNNTRARSVVKNQYIALELMFVQKLPSFAVSGEEVPLLPIYAQAANLHLLLLRDASIFGKEWGLSASEISTFYNRQVERTRDYSDHCVKWYNTGLNNLRGTNAKSWVRYNQFRKDMTLMVLDLVALFPSYDTLVYPIKTTSQLTREVYTDAIGTVHPNQAFASTTWYNNNAPSFSAIEAAVIRSPHLLDFLEKVTIYSLLSRWSNTQYMNMWGGHRLESRPIGGALNTSTQGSTNTSINPVTLQFTSRDVYRTESWAGLNLFLTQPVNGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLPSGAAVVRGPGFTGGDILRRTNTGTFGDIRVNINPPFAQRYRVRIRYASTTDVQFHTSINGKAINQGNFSATMNRGEDLDYKTFRTVGFTTPFSLSDVQSTFTIGAWNFSSGNEVYIDRIEFVPVEVTYEAEHDFEKAQEEVTALFTSTNPGGLKTNVTEYHIDQVSNLVESLSMNSISMKREN

SEQ ID NO: 221 - protein, 719 aa, Bacillus thuringiensis C18
MKLKNPDKHQTLSSNAKVDKIATDSLKNETDIELKNMNNEDYLRMSEHESIDPFVSASTIQTGIGIAGKILGTLGVPFPGQIASLYSFILGELWPKGKSQWEIFMEHVEAIINRKISTYARNKALTDLKGLGDALAVYHESLESWVGNRNNTRARSVVKNQYIALELMFVQKLPSFAVSGEEVPLLPIYAQAANLHLLLLRDASIFEKNGGLSASEISTFYNRQVERTRDYSYHCVKWNNTGLNNLRATNGQSWVRYNQFRKDIELMVLDLVRVFPSYDTLVYPIKTTSQLTREVYTDAIGTVDPNQALRSTTWYNNNAPSFSAIEAAVIRSPHLLDFLEKVTIYSLLSRWSNTQYMNMWGGHRLESRPIGGALNTSTQGSTNTSINPVTLQFTSRDFYRTESWAGLNLFLTQPVNGVPRVDFHWKFPTLPIASDNFYYLGYAGVGTQLQDSENELPPETTGQPNYESYSHRLSHIGLISGSHVKALVYSWTHRSADRTNTIEPNSITQIPLVKAFNLSSGAAVVRGPGFTGGHILRRTKSGTFGHIRVNINPPFAQRYRVRMSYASTTDLQFHTSINGKAINQGNFSATMNRGEDLDYKTFRTVGFTTPFSFSDVQSTFTIGAWNFSSGNEVYIGRIEFVPVEVTYEAEYDFEKAQEKVTALFTSTNPRGLKTDVKDYHIDQVSNLVESLSDELYLDEKRELFEIVKYAKQIHIERNM

SEQ ID NO: 222 - protein, 719 aa, Bacillus thuringiensis
MKSKNQNMYRSFSSNATVDKSFTDPLEHNTNMELQNSNHEDCLKMSEYESVEPFVSVSTIQTGIGIAGKILGNLGVPFAGQVASLYSFILGELWPKGKSQWEIFMEHVEELINQKISTYARNKALADLKGLGDALAVYHESLESWIENRNNTRVRSVVKNQYIALELMFVQKLPSFAVSGEEVPLLPIYAQAANLHLLLLRDASIFGKEWGLSESEISTFYNRQSSQTQEYSDYCSEWYNTGLNRLRGTNAESWVRYNQFRRDMTLMVLDLVALFPSYDTRMYPIPTSAQLTREVYTDAIGTVHPNASFASTTWYNNNAPSFSTIEAAVVRNPHLLDFLEQVTIYSLLSRWSNTQYMNMWGGHKLEFRTIGGTLNTSTQGSTNTSINPVTLPFTSRDVYRTESLAGLNLFLTQPVNGVPRVDFHWKFVTHPIASDNFYYPGYAGIGTQLQDSENELPPETTGQPNYESYSHRLSHIGLISASHVKALVYSWTHRSADRTNTINSDSITQIPLVKAFNLPSGASVVRGPGFTGGDILQRTNTGTFGDIRVNINPPFAQRYRLRIRYASTTNLEFHTSINGKAINQGNFSATMNRGEDLDYKAFRTVGFTTPFSFSNAQSTFTIGAWNFSLGNEVYIDRIEFVPVEVTYEAEYDLKKAQDEITAMFTSTNLRRLKTNVTDCHIDQVSNLVESLSDEFYLDEKRELFEIVKYAKQLNIERNM

SEQ ID NO: 223 - protein, 719 aa, Bacillus thuringiensis BTC007
MKLKNPDKHQSLSSNAKVDKIATDSLKNETDIELKNINHEDFLRMSEHESIDPFVSASTIQTGIGIAGKILGTLGVPFAGQIASLYSFILGELWPKGKSQWEIFMEHVEELIDQKISTYARNIALADLKGLGDALAVYHESLESWIKNRNNARATSVVKSQYIALELLFVQKLPSFAVSGEEVPLLPIYAQAANLHLLLLRDASVFGKEWGLSNSQISTFYNRQVERTSDYSDHCVKWYSTGLNNLRGTNAESWVRYNQFRKDMTLMVLDLIALFPSYDTLVYPIKTTSQLTREVYTDAIGTVHPNASFASTTWYNNNAPSFSAIESAVVRNPHLLDFLEQVTIYSLLSRWSNTQYMNMWGGHRLEFRTIGGVLNTSTQGSTNTSINPVTLPFTSRDVYRTESLAGLNLFLTQPVNGVPRVDFHWKFATLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 224 - protein, 710 aa, Bacillus thuringiensis
  MISC_FEATURE (200)..(200): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MKSKNQNMHQSLSNNATVDKNFTGSLENNTNTELQNFNHEGIEPFVSVSTIQTGIGIAGKILGNLGVPFAGQVASLYSFILGELWPKGKSQWEIFMEHVEELINQKISTYARNKALADLKGLGDALAVYHESLESWIENRNNTRTRSVVKSQYITLELMFVQSLPSFAVSGEEVPLLPIYAQAANLHLLLLRDASIFGKXWGLSDSEISTFYNRQSGKSKEYSDHCVKWYNTGLNRLMGNNAESWVRYNQFRRDMTLMVLDLVALFPSYDTQMYPIKTTAQLTREVYTDAIGTVHPHPSFTSTTWYNNNAPSFSTIEAAVVRNPHLLDFLEQVTIYSLLSRWSNTQYMNMWGGHKLEFRTIGGTLNTSTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRKNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEEVTALFTSTNPRGLKTDVKDYHIDQVSNLVESLSDKFYLDEKRELFEIVKYAKQLHIERNM

SEQ ID NO: 225 - protein, 381 aa, Bacillus thuringiensis ly4a3
RDVIVIVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDKIEFIP

SEQ ID NO: 226 - protein, 1167 aa, Bacillus thuringiensis EG5847
MEINNQKQCIPYNCLSNPEEVLLDGERILPDIDPLEVSLSLLQFLLNNFVPGGGFISGLVDKIWGALRPSEWDLFLAQIERLIDQRIEATVRAKAITELEGLGRNYQIYAEAFKEWESDPDNEAAKSRVIDRFRILDGLIEANIPSFRIIGFEVPLLSVYVQAANLHLALLRDSVIFGERWGLTTKNVNDIYNRQIREIHEYSNHCVDTYNTELERLGFRSIAQWRIYNQFRRELTLTVLDIVALFPNYDSRLYPIQTFSQLTREIVTSPVSEFYYGVINSGNIIGTLTEQQIRRPHLMDFFNSMIMYTSDNRREHYWSGLEMTAYFTGFAGAQVSFPLVGTRGESAPPLTVRSVNDGIYRILSAPFYSAPFLGTIVLGSRGEKFDFALNNISPPPSTIYRHPGTVDSLVSIPPQDNSVPPHRGSSHRLSHVTMRASSPIFHWTHRSATTTNTINPNAIIQIPLVKAFNLHSGATVVRGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTNQLGLKTDVTDYQIDQVSNLVECLSDEFCLDEKRELSEKVKHAKRLSDKRNLLQDPNFTSINRQLDRGWRGSTDITIQGGNDVFKENYVTLPGTFDECYPTYLYQKIDESKLKAYTRYELRGYIEDSQDLEVYLIRYNAKHETVNVPGTGSLWPLSVESPIGRCGEPNRCVPHIEWNPDLDCSCRDGEKCAHHSHHFSLDIDVGCTDLNEDLGVWVIFKIKTQDGHARLGNLEFLEEKPLLGEALARVKRAEKKWRDKREQLQFETNIVYKEAKESVDALFVDSHYNRLQADTNITMIHAADKRVHRIREAYLPELSVIPGVNADIFEELEGLIFTAFSLYDARNIIKNGDFNNGLSCWNVKGHVDIQQNDHRSVLVVPEWESEVSQEVRVCPGRGYILRVTAYKEGYGEGCVTIHEIEDNTDELKFSNCIEEEVYPTDTGNDYTAHQGTTGCADACNSRNVGYEDGYEINTTASVNYKPTYEEEMYTDVRRDNHCEYDRGYGNHTPLPAGYVTKELEYFPETDTVWIEIGETEGTFIVDSVELLLMEE

SEQ ID NO: 227 - protein, 1168 aa, Bacillus thuringiensis
MEINNQNQCIPYNCLSNPEEVFLDGERILPDIDPLEVSLSLLQFLLNNFVPGGGFISGLLDKIWGALRPSDWELFLAQIEQLIDRRIERTVRAKAIAELEGLGRSYQLYGEAFKEWEKTPDNTAARSRVTERFRIIDAQIEANIPSFRVSGFEVPLLLVYTQAANLHLALLRDSVVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWTHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQKAVNALFTSSNQLGLKTDVTDYHIDQVSNLVACLSDEFCLDEKRELSEKVKHAKRLSDERNLLQDQNFTGINRQVDRGWRGSTDITIQGGNDVFKENYVTLPGTFDECYPTYLYQKIDESKLKPYTRYELRGYIEDSQDLEVYLIRYNAKHETLNVPGTGSLWPLAAESSIGRCGEPNRCAPHIEWNPELDCSCRDGEKCAHHSHHFSLDIDVGCTDLNEDLGVWVIFKIKTQDGYARLGNLEFLEEKPLLGEALARVKRAEKKWRDKRDKLEWETNIVYKEAKESVDALFVDSQYNRLQTDTNIAMIHVADKRVHRIREAYLPELSVIPGVNAAIFEELEGLIFTAFSLYDARNVIKNGDFNHGLSCWNVKGHVDVEEQNNHRSVLVVPEWEAEVSQEVRVCPGRGYILRVTAYKEGYGEGCVTIHEIEDHTDELKFRNCEEEEVYPNNTVTCNDYPANQEEYRAAETSRNRGYGESYESNSSIPAEYAPIYEKAYTDGRKENSCESNRGYGNYTPLPAGYVTKELEYFPETDKVWIEIGETEGTFIVDSVELLLMEE

SEQ ID NO: 228 - protein, 1168 aa, Bacillus thuringiensis
MEINNQNQCIPYNCLSKPEEVFLDGERILPDIDPLEVSLSLLQFLLNNFVPGGGFISGLIDKIWGALRPSEWELFLAQIEQLIDRRIEATVRAKAIAELEGLGRSYQLYGEAFKEWEKTPDNTAARSRVTERFRIIDAQIEANIPSFRVSGFEVPLLSVYTQAANLHLALLRDSVIFGERWGLSTTNVNDIYNRQVKRIHEYSDHCVDTYKTELERLEFRSIAQWRIYNQFRRELTLTVLDIVALFPNYDGRLYPIRTISQLTREIYTSPVSEFYYGPIYNHNMIGTFIERQLRRPHLMDFFNSMTMYTSDNRREYYWSGLEMTATLTSGNQVSFPLAGTRGNSAPPVSVRKTGEGIYRILSEPFYSAPFLGTSVLGSRGEEFAFASNTTTSLPSTIYRNRGTVDSLVSIPPQDYSVPPHRGYSHLLSHVTMHNSSPIFHWTHRSATPRNIIYPDSITQIPVVKASHLSGGSVIKGPGHTGGDLISLPVNNFTHFRIPFQANTPQRYRIRICYAADSDGTLDSGVFLSAAAGDGFNTTSYRATMSPEGSLTSRDFQFLDLNTSFTSDVASNLWLHFIRYIRPGNLYIDRAEFIPVDATFEAGYNLERAQKAVNALFTSTNQKGLQTDVTDYHIDQVSNLVDCLSDEFCLDEKRKLSEKVKQAKRLSDERNLLQDSNFRGINREQDRGWRGSTDITIQGGNDVFKENYVTLPGTFDACYPTYLYQKVDESKLKAYTRYQLRGYIEDSQDLEVYLIRYNAKYETLNVPGMGSLWPLSVESPIGKCGEPNRCVPQLEWNPDFDCSCRDGEKCAHHSHHFSLDIDVGCTDLNENLGIWVIFKIKTQDGHARLGNLEFLEEKPLLGEALARVKRAEKKWRDKREILQSETNIVYKEAKEAVDGLFVDSQYERLQSDTNIAMIHAADKRVHRIREAYLPELSVIPGVNAAIFEELEGRIFTAYSLYDARNVIKNGDFNNGLSCWNVKGHVDIKQNGHRSVLVIPEWEAQVSQEVRVCPGRGYILRVTANKEGYGEGCVTIHEIENHTEKLKFRNCEEEEVYPNNTGTCNDYTAHQQGTAGCADACNTRNVGYEDAYEMNTTTSVNYKPTYEEEVYTDGRRDNPCEMERGYTPLPVGYVTKELEYFPETNTVWIEIGETEGKFIVDSVELLLMEE

SEQ ID NO: 229 - protein, 1215 aa, Bacillus thuringiensis morrisoni BF190
MNSNRKNENEIINALSIPAVSNHSAQMDLSPDARIEDSLCVAEGNNIDPFVSASTVQTGISIAGRILGVLGVPFAGQLASFYSFLVGELWPSGRDPWEIFMEHVEQIVRQQQITDSVRDTAIARLEGLGRGYRSYQQALETWLDNRNDARSRSIIRERYIALELDITTAIPLFSIRNEEVPLLMVYAQAANLHLLLLRDASLFGSEWGMSSADVNQYYQEQIRYTEEYSNHCVQWYNTGLNRLRGTTAETWVRYNQFRRDLTLGVLDLVALFPSYDTRTYPIPTTAQLTREVYTDPNGVVAGPNNSWFRNGASFSAIENAIIRQPHLYDFLTNLTIYTRRSQVGTTIMNLWAGHRITFNRIQGGSTSEMVYGAITNPVSVSDIPFVNRDVYRTVSLAGGLGSLSGIRYGLTRVDFDMIFRNHPDIVTGLFYHPGHAGIATQVKDSDTELPPETTEQPNYRAFSHLLSHISMGPTTQDVPPVYSWTHQSADRTNTINSDRITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTIGADTFSSGNEVYVDRFELIQVTATFEAESDLERARKAVNALFTSTNPRGLKTDVTDYHIDQVSNLVECLSDEFCLDKKRELLEEVKYAKRLSDERNLLQDPTFTSISGQTDRGWIGSTGISIQGGDDIFKENYVRLPGTVDECYPTYLYQKIDESQLKSYTRYQLRGYIEDSQDLEIYLIRYNAKHETLSVPGTESPWPSSGVYPSGRCGEPNRCAPRIEWNPDLDCSCRYGEKCVHHSHHFSLDIDVGCTDLNEDLGVWVIFKIKTQDGHAKLGNLEFIEEKPLLGKALSRVKRAEKKWRDKYEKLQLETKRVYTEAKESVDALFVDSQYDKLQANTNIGIIHGADKQVHRIREPYLSELPVIPSINAAIFEELEGHIFKAYSLYDARNVIKNGDFNNGLSCWNVKGHVDVQQNHHRSVLVLSEWEAEVSQKVRVCPDRGYILRVTAYKEGYGEGCVTIHEFEDNTDVLKFRNFVEEEVYPNNTVTCNDYTTNQSAEGSTDACNSYNRGYEDGYENRYEPNPSAPVNYTPTYEEGMYTDTQGYNHCVSDRGYRNHTPLPAGYVTLELEYFPETEQVWIEIGETEGTFIVGSVELLLMEE

SEQ ID NO: 230 - protein, 1170 aa, Bacillus thuringiensis kurstaki K1
MDNNPKIQECIPYNCLNNPESEILDIEGLSTRSREQVAEISLGLTRFLLENLFPGATFGFGLFDIIWGIFGPDQWSMFLEQIEQLIDQRIETVERNRAIQTLIGLSNSYDVNIEALKEWENNPDNSASQERVRNRFRTTDDALITSIPLLAIPNFEIATLSVYVQAANLHLSLLRVAVFFGERWGLTQINVDDLYRRLTNNIRKYSDHCARWYNEGLDNISGLSRSINFQREVTISVLDIVALFPNYDIRTYPISTTSQLTREIFTSPIVVPNDFSVAYEGVRRAPHLFDFLEKLVIYTGDRSGIRHWAGHEITSRRTDSYHGIIRYPLYGTAANAESPYTLALQPSESIYRTLSEPIFSQTGGLSPHRRRVVEGVEFSIVNNNVNPSSFVYRRKGSLDSFTELPPEDESVPPYIGISHQLCHVGFGRTNVIFEPSNFARVPVFSWTHRSATPTNTIDPDRITQIPSVKASSLRNSTVVSGPGFTGGDIVRMGAVHQIYATDLSMNVRPSVALSRYLIRLRYACRGSSNIVIHGPSIRFVSLPSTMSNDEPLTYQSFRYASITTPITRPIYNMFNLSISRISGVQNLFIDRIEFIPVDANFEAERDLERAQKAVNALFTSTNQRGLKIDVTDYHIDQVSNLVDCLSDEFCLDEKRELSEKVKHAKRLSDERNLLQDLNFKDINRQPERGWSGSTGITIQGGDDVFKENYVTLPGTFDECYPTYLYQKIDESKLKAYTRYQLRGYIEDSQDLEIYLIRYNAKHETVNVPGSGSLWPLSVESSVGKCGEPNRCASRMEWNPDLDCSCRDGEKCAHHSHHFSLDIDVGCTDLNEDLGVWVIFKIKTQDGHAKIGNLEFLKEKLLLGEALARVKKAEKKWRDKRDKLEWETNVVYKEAKESVDALFVDSQYSRLQADTNIAMIHAADKRVHRIREAYLPELTVIPGVNASIFEELEGRIFTAYSLYGARNVIKNGDFNNGLSCWNVKGHVEVQQIHHRSVLVVPSWKTEVSQEVCVCPGRGYILRVTAYKEGYGEGNVTIHEIENNTDELKFRNCEEEEVYPNNTVTCNDYTVNQEEYKGTCTSRNRGYDESYESSSSESAYYASVYEEKGYTDGRRENLCEFNRGYGDYTSLPTAYVTKELEYFPETDKVWIEIGETEGAFILDSVELLLMEE

SEQ ID NO: 231 - protein, 699 aa, Bacillus thuringiensis LBIT 1189
MKPNNQNNHQTLLSNVTVDKPFADALKNETTMELKNSNHEDCLKMSEHESIEPFVSASTIQTGIGIAGKILGSLGVPFAGQVASLYSFILGELWPKGKSQWEIFMEHVEELVAQKISTYARNKALSDLKGLGDALAVYHESLESWIENRNNTRARSVVKNQYIALELMFVQNLPSFAVSGEEVPLLPIYRQAANLHLLLLRDASTFGKEWGLSTSEISTFYNRQSNRTIEYSDYCSKWYNTGLNRLRGTNAESWVRYNQFRRDMTLMVLDLVALFPSYDTHMYPIKTSAQLTREVYTDLNGVVAGPNNSWFKNGASFSAIENAIIRKPHLYDFITNLTIYTRISRANPSYMNLWAGHRITFNRIGSSNSSELVYGAITNPVSTSSLSFVNEDIYRTTSLAGALGTLSGLIYGLTKADFDTRFRNHTNIASGKTYFPGHSGIGTQVRNSETELPPETTEQPSYRAFSHLLSHISMSPTTAATPPVYSWTHQSADRTNTINSDSITQIPLVKANNLHPGAIVVKGPGFTGGDILRRTSTGTFVDLPVNLINWQLSQRYRVRIRYASTTDLQFHTSINGRAINQGNFSATMNRGDALESRTFRTAGFTTPFNFSDAQSTFTISAWNFSSGNEVYIDQIEFIPTEVTFEAEYDSEKAQKAVNDLFTPTNPRGLKADVTDYHIDQVSNLVECLFDEDCHNEKRE

SEQ ID NO: 232 - protein, 753 aa, Bacillus thuringiensis fukuokaensis
MNPYQNNDEIVDVPENYDNNLNRYPYANDPNVAMQNTNYKDWMNGYEEINPSSITAILASIGILNRVIALTGVLGNTQEVISIIQDALGFIRNGTGNELLIHVEQLIQQTLATQYRSAATGAIYGISRSYDNYLMFFRQWERNRTRENGQQVESAFTTINTLCINALAPQASLSRRGFETLLLPNYAMAANFHLLLLRDAVLYRNQWLSNSISTANVNLNILRAAINEYITHCTRWYQDGLNRFDRSSRANMNEWRRFNAYRRDMTLSVLDFATVFPTYDPVLFPAATNVELTRVVYTDPIVMAGGRTAIPGFTRMENLVNSASRVSFLNQMNIYTSFYFRPHNIPRYYWSGNQNFLSNGTSNLYGYRSDGRTTFNVSNIDIFRVNMTTHIGGAFTDDYRGLHRAEFIGANTQNNQRTSLLYSVEIPSSHFRFENHTVFLPGESGLEPNERNYTHRLFQMMNEVSVNPNARGRVFLHAWTHRSLRRTNGLRSDQILQIPAVKTISNGGDRAVVLNYGENIMKLDNLTTGLSYKLTAVDSEASNTRFIVRVRYASMNNNKLNLVLNGAQIASLNVEHTVQRGGSLTDLQYGNFKYATFAGNFKMGSQSILGIFKEIPNIDFVLDKIELIPSNFMSSLEQTQNYNTYNQDTIYTHNQGYDTYDQNSSGMYHQSYNNYDQNMDTTYQPSYDNYNQNASGTYDDGYNPNASDSYDQSYTNNYSQNTNSMYDQGYYNNNYDQHSGCTCNQGYDNNYLK

SEQ ID NO: 233 - protein, 765 aa, Bacillus thuringiensis higo LBIT-976
MNPYQNKNEYEIVNNPQNYNTVSNRYPYTNDPNVAIQNTNYKDWMNGYEEINPSLISLILASIGILNQAIALTGVLGKTPENINIVQEMVGLISGSTGNDLLVHTEQLIQQTLAQQYRNAATGAVNAISKSYNDYLMFFRQWERNRTSQNGLLVESAFNSVNTLCLRTLTPQEALSRRGFETLLLPNYAQAANFHLLLLRDAVLYRTQWLPNFISTTNANIEILERSINQYRNHCNHWYNDGLNRFARTSFDDWVRFNAYRRDMTLSVLDFVTVFPTYNPINFPTPTNVELTRIVYTDPISPPRGYARTGSPSFRQMEDLIISGSPSFLNQLSIFTTYYHDPRNVNRDFWAGNRNYLSNGTSRQSGATTPWRTNIPMQNIDIFRVNLTTHDIDDISRSYGGVHRSDFIGVNTINNQRTTLFYHQNVDTSRFLIRNETVFLPGDSGLAPNERNYTHRLFQVMTTYRTNPNARRAAFLHAWTHRSLRRRNGFRTDQIMQIPAVKSISNGGDRAVISYTGENMMKLDNLTASLSYKLTAEDSEASNTRFIVRIRYASMNNNRLNLILNGTQIASLNVEGTMQNGGSLTNLQSENFKYATFSGNFKMGSQSIVGIFKEISNADFIFDQIEFIPIHFMPLLEQKQSYNNYDQNMDTTYQPNYDTYNQNANGMYDDTYYPNNNDSYNQNNTDMYDSGYNNNQNTNYNYDQEYNTYNQNMENTYDQSYENYNPETNNYNQYPNDMYNQEYTNDYNQNSGCRCNQGYNNNYPK

SEQ ID NO: 234 - protein, 1286 aa, Bacillus thuringiensis roskildiensis
MADLTELYPSYHNVLARPIRLDSIFDPFIDIFNALKGGWEEFAKTGYKDPLEQHLKIAWNASQNGTIDYLALTKASISFIGLIPDADAVVPFINMFVDFIFPKLFGEGSQQNSQAQFFELIIEKVKEIVDQEFRNFTLNTLLNDLDGMQTTLEHFQNDVQIAICQGEQPGLILDEKHPPCTPTKNHLVSVKESFKNARTSIETVLPHFKNPMTNNKTPDFNSDTVLLTLPMYTTAATLNLILHQGYIQFVERWKSVDYDEAFINQTKADLQHRIQEYSTTVSTTFEKFKPTLSNKKSSINTYNKYVRSMTLNCLDIAATWPTLDNVNYPSNVEIQLDQTRLVFSNLVGPFEGNDDISTYTRRSIMNYSKGDTPGDVNSAIQSLRYPRLELSKVQFYTHDQRSNGVRHCYTSGFNLTFNDNSSMSAKQDESATADSPPLTAPIKNMNANSQNSQYYDYSSINIDNQGGGGCSAFPSYQSNNPILPNQKINVFYPYGSSAHPIDPHTTDPDTWFKLGYVSSHIPYDLTPQNVIGEIDQDTKQPSLILKGFPAEKGYGGSIEYVSEPLNGANAAKLTLNQILYMQVTNLTTQKYQIRLRYATKNDTTASVWFHIIGPNNQDIINHSPDIPPRSNNKMFVQGENGKYVLDTLVDSIELPSGQLTILIQNINPDQDLFLDRIEFVPIPTLPTNPNISIPKTDTSPKDSKVLWEASPDIPIANTITLTGSVYDFADITFELYKNGNMVTSYPIKGPGPIPHRSHGNYVSCSQGILSYNYENKPVLDGFDQLRININSDPSFYDSNSGCDTKNQYSAEIKINPNLSATTDLEKITNQVNQLFTSSSQTELANTITDYRIDQIVMKVDALSNNVFGVEKKALRKLVNQAKQLSKARNVLAGGNFEKGHEWVLGREATMIANHELFKGDHLLLPPPTLYPSYAYQKIDESKLKSNTRYTVSGFIAQSEHLEVIVSRYGKEVHDMLDVPYEEALPISSDESPNCCKPATCQCPSCDGSQPDSHFFSYSIDVGSVQSDVNLGIEFGLRIAKPNGFAKISNLEIKEDRPLTDQEIKKIQRKEQKWKKAFDQEQAEVAATFQPTLDQINALYQNEDWNGSLHPHVTYQHLSAVVLPTLPKQRHWFMEDREGEHYGVTQQFQQALDRGFQQIEEQNLIHNGSFANGLTDWTVTGDAQLTIFDEDPVLELAHWDASVSQTIEIMDFEEETEYKLRVRGKGKGTVTVQHGEEELETMTFNTTSFTTQEQTFYFEGDTVDVHVQSENNTFLVDSVELIEVVEE

SEQ ID NO: 235 - protein, 722 aa, Bacillus thuringiensis
MKEQNLNKYDEITVQAASDYIDIRPIFQTNGSATFNSNTNITTLTQAINSQAGAIAGKTALDMRHDFTFRADIFLGTKSNGADGIAIAFHRGSIGFVGTKGGGLGILGAPKGIGFELDTYANAPEDEVGDSFGHGAMKGSFPSFPNGYPHAGFVSTDKNSRWLSALAQMQRIAAPNGRWRRLEIRWDARNKELTANLQDLTFNDITVGEKPRTPRTATWRLVNPAFELDQKYTFVIGSATGASNNLHQIGIIEFDAYFTKPTIEANNVNVPVGATFNPKTYPGINLRATDEIDGDLTSKIIVKANNVNTSKTGVYYVTYYVENSYGESDEKTIEVTVFSNPTIIASDVEIEKGESFNPLTDSRVGLSAQDSLGNDITQNVKVKSSNVDTSKPGEYEVVFEVTDSFGGKAEKDFKVTVLGQPSIEANNVELEIDDSLDPLTDAKVGLRAKDSLGNDITKDIKVKFNNVDTSNSGKYEVIFEVTDRFGKKAEKSIEVLVLGEPSIEANDVEVNKGETFEPLTDSRVGLRAKDSLGNDITKDVKIKSSNVDTSKPGEYEVVFEVTDRFGKYVEKTIGVIVPVIDDEWEDGNVNGWFYAGQDIKLLKDPDKKAYKGDYVFYDSRHVAISKTIPLTDLQINTNYEITVYAKAESGDHHLKVTYKKDPAGPEEPPVFNRLISTGTLVEKDYRELKGTFRVTELNKAPLIIVENFGAGYIGGIRIVKIS

SEQ ID NO: 236 - protein, 722 aa, Bacillus thuringiensis FZ-4
MKEQNLNKYDEITVQAASDYIDIRPIFQTNGSATFNSNTNITTLTQAINSQAGAIAGKTALDMRHDFTFRADIFLGTKSNGADGIAIAFHRGSIGFVGTKGGGLGILGAPKGIGFELDTYANAPEDEVGDSFGHGAMKGSFPSFPNGYPHAGFVSTDKNSRWLSALAQMQRIAAPNGRWRRLEIRWDARNKELTANLQDLTFNDITVGEKPRTPRTATWRLVNPAFELDQKYTFVIGSATGASNNLHQIGIIEFDAYFTKPTIEANNVNVPVGATFNPKTYPGINLRATDEIDGDLTSKIIVKANNVNTSKTGVYYVTYYVENSYGESDEKTIEVTVFSNPTIIASDVEIEKGESFNPLTDSRVGLSAQDSLGNDITQNVKVKSSNVDTSKPGEYEVVFEVTDSFGGKAEKDIKVTVLGQPSIEANNVELEIDDLFDPLTDAKVGLRAKDSLGNDITKDVKVKFNNVDTSNSGKYEVIFEVTDRFGKKAEKSIEVLVLGEPSIEANDVEVNKGETFEPLTDSRVGLRAKDSLGNDITKDVKIKSSNVDTSKPGEYEVVFEVTDRFGKYAEKTIGVIVPVIDDEWEDGNVNGWKFYAGQDIKLLKDPDKAYKGDYVFYDSRHVAISKTIPLTDLQINTNYEITVYAKAESGDHHLKVTYKKDPAGPEEPPVFNRLISTGTLVEKDYRELKGTFRVTELNKAPLIIVENFGAGYIGGIRIVKIS

SEQ ID NO: 237 - protein, 721 aa, Bacillus thuringiensis EG4140
MKDSISKGYDEITVQASDYIDIRSIFQTNGSATFNSTTNITTLTQATNSQAGAIAGKTALDMRHDFTFRADIFLGTKSNGADGIAIAFHRGSIGFVGEKGGGLGILGALKGIGFELDTYANAPQDEQGDSFGHGAMRGLFPGFPNGYPHAGFVSTDKNRGWLSALAQMQRIAAPNGRWRRLAIHWDARNKKLTANLEDLTFNDSTVLVKPRTPRYARWELSNPAFELDQKYTFVIGSATGASNNLHQIGIIEFDAYFTKPTIEANNVSVPVGATFNPKTYPGINLRATDEIDGDLTSEIIVTDNNVNTSKSGVYNVTYYVKNSYGESDEKTIEVTVFSNPTIIASDVEIEKGESFNPLTDSRVRLSAQDSLGNDITSKVKVKSSNVDTSKPGEYDVVFEVTDNFGGKAEKEIKVTVLGQPSIEANDVELEIGDLFNPLTDSQVGLRAKDSLGKDITNDVKVKSSNVDTSKPGEYEVVFEVTDRFGKKAEKSIKVLVLGEPSIEANNVEIEKDERFDPLTDSRVGLRAKDSLGKDITNDVKVKSSNVDTSKPGEYEVVFEVTDRFGKYVKKLIVVIVPVIDDEWEDGNVNGWKFYAGQDITLLKDPEKAYKGEYVFYDSRHAAISKTIPVTDLQVGGNYEITVYVKAESGDHHLKVTYKKDPKGPEEPPVFNRLISTGKLVEKDYRELKGTFRVTELNQAPLIIVENFGAGYIGGIRIVKIS

SEQ ID NO: 238 - protein, 716 aa, Bacillus thuringiensis
MKDSISKGYDEITVQASDYIDISIFQTNGSATFNSTTITTLTQATNSQAGAIGKTALDMRHDFTFRAIFLGTKSNGADGIAIAFHRGSIGFVGEKGGGGILGALKGIGFELDTYANAPQDEQGDSFGHGAMRGLFPGFPNGYPHAGFVSTDKNRGWLSALAQMQRIAAPNGRWRRLAIHWDARNKKLTANLEDLTFNDSTVLVKPRTPRYARWELSNPAFELDQKYTFVIGSATGASNNLHQIGIIEFDAYFTKPTIEANNVSVPVGATFNPKTYPGINLRATDEIDGDLTSEIIVTDNNVNTSKSGVYNVTYYVKNSYGESDEKTIEVTVFSNPTIIASDVEIEKGESFNPLTDSRVRLSAQDSLGNDITSKVKVKSSNVDTSKPGEYDVVFEVTDNFGGKAEKEIKVTVLGQPSIEANDVELEIGDLFNPLTDSQVGLRAKDSLGKDITNDVKVKSSNVDTSKPGEYEVVFEVTDRFGKKAEKSIKVLVLGEPSIEANNVEIEKDERFDPLTDSRVGLRAKDSLGKDITNDVKVKSSNVDTSKPGEYEVVFEVTDRFGKYVKKLIVVIVPVIDDEWEDGNVNGWKFYAGQDITLLKDPEKAYKGEYVFYDSRHAAISKTIPVTDLQVGGNYEITVYVKAESGDHHLKVTYKKDPKGPEEPPVFNRLISTGKLVEKDYRELKGTFRVTELNQAPLIIVENFGAGYIGGIRIVKIS

SEQ ID NO: 239 - protein, 632 aa, Bacillus thuringiensis
MNSKSIIEKGVQENQYIDIRNICSINGSAKFDPNTNITTLTEAINSQAGAIAGKTALDMRRDFTLVADIYLGSKSSGADGIAIAFHRGSIGFIGTMGGGLGILGAPNGIGFEIDTYWKATSDETGDSFGHGQMNGAHAGFVSTNRNASYLTALAPMQKIPAPNNKWRVLTINWDARNNKLTARLQEKSNDASTSTPSPRYQTWELLNPAFDLNQKYTFIIGSATGAANNKHQIGVTLFEAYFTKPTIEANPVDIELGTAFDPLNHEPIGLKATDEVDGDITKDITVEFNDIDTSKPGAYRVTYKVVNSYGESDEKTIEVVVYTKPTITAHDITIKKDLAFDPLNYEPIGLKATDPIDGDITDKIAVKFNNVDTSKPGKYHVTYKVINSYEKIDEKTIEVTVYTKPSIVAHDVEIKKDTAFDPLNYEPIGLKATDPIDGDITDKITVESNDVDTSKPGAYSVKYKVVNNYEESDEKTIAVTVPVIDDGWENGDPTGWKFFSGETITLEDDEEHALNGKWVFYADKHVAIYKQVELKNNIPYQITVYVKPEDEGTVAHHIVKVSFKSDSAGPESEEVINERLIDAEQIQKGYRKLTSIPFTPTTIVPNKKPVIIVENFLPGWIGGVRIIVEPTK

SEQ ID NO: 240 - protein, 267 aa, Bacillus thuringiensis
MGIINIQDEINNYMKEVYGATTVKSTYDPSFKVFNESVTPQFTEIPTEPVNNQLTTKRVDNTGSYPVESTVSFTWTETHTETSAVTEGVKAGTSISTKQSFKFGFVNSDVTLTVSAEYNYSTTNTTTTTETHTWSDSTKVTIPPKTYVEAAYIIQNGTYNVPVNVECDMSGTLFCRGYRDGALIAAVYVSVADLADYNPNLNLTNKGDGIAHFKGSGFIEGAQGLRSIIQVTEYPLDDNKGRSTPITYLINGSLAPNVTLKNSNIKF

SEQ ID NO: 241 - protein, 674 aa, Bacillus thuringiensis jegathesan
MNQYQNKNEYEILESSQNNMNMPNRYPFADDPNAVMKNGNYKDWVNECEGSNISPSPAAAITSKIVSIVLKTLAKAVASSLADSIKSSLGISKTITENNVSQVSMVQVHQIINRRIQETILDLGESSLNGLVAIYNRDYLGALEAWNNNKSNINYQTNVAEAFKTVEREFFTKLKGIYRTSSSQITLLPTFTQAANLHLSMLRDAVMYQEGWNLQSHINYSKELDDALEDYTNYCVEVYTKGLNALRGSTAIDWLEFNSFRRDMTLMVLDLVAIFPNYNPVRYPLSTKISLSRKIYTDPVGRTDSPSFGDWTNTGRTLANFNDLEREVTDSPSLVKWLGDMTIYTGAIDSYRPTSPGDRIGVWYGNINAFYHTGRTDVVMFRQTGDTAYEDPSTFISNILYDDIYKLDLRAAAVSTIQGAMDTTFGVSSSRFFDIRGRNQLYQSNKPYPSLPITITFPGEESSEGNANDYSHLLCDVKILQEDSSNICEGRSSLLSHAWTHASLDRNNTILPDEITQIPAVTAYELRGNSSVVAGPGSTGGDLVKMSYHSVWSFKVYCSELKNYRVRIRYASHGNCQFLMKRWPSTGVAPRQWARHNVQGTFSNSMRYEAFKYLDIFTITPEENNFAFTIDLESGGDLFIDKIEFIPVSGSAFEYEGKQNIEKTQKAVNDLFIN

SEQ ID NO: 242 - protein, 675 aa, Bacillus thuringiensis sotto
MVNPYQNKKESVFYEHSNNQKDIPNRYPFTNNPNAVMKNGNYKDWVNECEGSNVSPSPAAAVTSAIISIVLKTLAKALVSSLVDAIKSSLGISEVITKNNVSQLSMELVNQLINRRIQETIMDLGSASLNGLMSIYKRYLNALEAWDKDKSNITLQENVIEEFKYVESRFFENLKGIYRTSSSQITLLPTFAQAANLHLSMLRDAVMYQEGWNLQSHLDYKMELDIALKDYTNYCVEVYNRGLNALRGSTALDWLEFNSFRRDMTLMVLDLVAIFPNYDPVQYPLPTKIGLSRKIYTDPVGTTRDTDFGNWTLTDRTLANFNDLERDVTDSPSLVKWLVDMNIYTGAIDSYPISGPGGERIGVWYGNMNSFVLTGSRELSYNMYGEIAHEDPITNIRDNDIYKVDLRAAYVATIRNALDSTFGVSSSHFFNVMGKNELYQSKQPYPSYPITITFPGEESLEGNVNDYSHLLCNVKNITGGLRQTSARGRSSLLSHAWTHKSLNPKNIIAADKITHIPAVKGSNLSASSAVIKGPGFTGGDLLRLGPNQFVDYILTPDNPQVSQIYFDVRLRYACMGGANILIQFWNKNWEIGVQLVSTTSSLENLKYENFAYITTRLSFTFGQGGYNMSIYNPTSNPNVIIDKIEFIPVSGTPFEYEGKHKLKNTQADVNNLFLN

SEQ ID NO: 243 - protein, 686 aa, Bacillus thuringiensis FCC-41
MNPYQNKNKYEILESSSDYTKISNKYPFANDPNITMKHMNYKDWMHMCETPTPFSASIIISVISIFGRVLGLSSSFANTSKYIAIITGILGLLGSSSSGSTNVWDNLIKHIEELTDRFIDTSVRFTGMSTVNGLNSQYLYYLDLFEDWYEDQNNEQKRNRLVGTFQTLGLAFINALGYRNTNGQEVRGTLSTAYEVQFLPSYAQAANLHLLLLKDAVTYGDKWILIEPTSNYYNRFKDNIARYTDYCTEYFHKGLDNLKKPGSDAVSWLRFNGFRRDMTLMVLDLITLFPLYDSVQYPLPTQIELSRQIYTDPVGATFSDFSNWTLTNRTLANFNDLEREVTDAPSLLKWLNSIEVYTGAIDSHRPTSPGERIGVWYGNRNTYINPDTNEVSYRFTGELAYENPYTFIGSFFDNDIYKVALRAAAVSTTFGSNDSTFGVSSSQFFNRRGIHQLYESSQPIPSWPITLAFPGEESSEGNANDYSHRLCDVKNITGGLRQTPARGRSSLLSHAWTHSSLKLRNIIAADKITQIPAVKTWEIRGTSSVVAGPGNTGGNLVKMSYHSVWNIKFTCQQLKRYRVRIRYASDGNCQLAMRRWRGGPGYVQEARHTVQRTFSGSMTYDSFKYLDIFTMPAEDYTFNLTIDLESGGALYIDKIEFTPDDITTLEYEGERDLEKTKNTVNDLFTN

SEQ ID NO: 244 - protein, 675 aa, Bacillus thuringiensis jegathesan
MNPYQNKSECEILNAPLNNINMPNRYPFANDPNAVMKNGNYKDWLNECDGITPSIFGTLGVLASIVISTINLATSPSIGDAFALVSSIGEYWPETKTSFPLSVADVNRLIREALDQNAINRATGKFNGLMDTYNTVYLKNLQDWYDTRIPANPQGDSQLREAARRSLEEIERDFRKALAGEFAEAGSQIVLLPIYAQAANIHLLILKDAMQFRTDLGLIRPVGVPITTSAEDPFESEFLLRIKKYTDHCISYYDDGLAKIRSRGSDGETWWEFNKFRREMTLTVLDLVALYPTHNIKLYPIPTQTELSRVVYTDPVGCFGNRKSDIFSRLNFDYLENRLTRPREPFNYLNSVQLFASTVSNSNNGEVLRGNLNKIMFEGGWTASRSGDGVTTGTPFSTMDWSYGWGYPRKHYAEITSRSQALPGLNNSIHVIVGIDSFRAIGPGGQGDHTFSLPGGDMYDCGKVQINPLEDYRNSDHWISDMMTINQSVQLASNPTQTFAFSALSLGWHHSSAGNRNVYVYDKITQIPATKTVREHPMIKGPGFTGGDLADLSSNSDILQYDLRSDYDDRLTEDVPFRIRIRCASIGVSTISVDNWGSSSPQVTVASTAASLDTLKYESFQYVSIPGNYYFDSAPRIRLLRQPGRLLVDRIEIIPVNFFPLSEQENKSVDSLFIN

SEQ ID NO: 245 - protein, 1163 aa, Bacillus thuringiensis finitimus B-1166
MNSEEMNHVNPFEISDNNDVSIPSQRYPFANDPADSVFCADDFLQSYGEFNMDNFGESEPFIDASGAINAAIGVTGTVLGFLGVPFAGALTTFYQKLFGFLFPNNNTKQWEEFMKQVEALIDEKISDAVRNKAISELQGLVNNITLYTEALEEWLENKENPAVRDRVLQRWRILDGFFEQQMPSFAVKGFEVLLLVVYTQAANLHLLSLRDAYIYGAEWGLTPTNIDQNHTRLLRHSAEYTDHCVNWYNTGLKQLENSDAKSWFQYNRFRREMTLSVLDVIALFPAYDVKMYPIPTNFQLTREVYTDVIGKIGRNDSDHWYSANAPSFSNLESTLIRTPHVVDYIKKLKIFYATVDYYGIYGRSGKWVGHIITSATSANTTETRNYGTIVNHDSVELNFEGKNIYKTGSLPQGVPPYQIGYVTPIYFITRAVNFFTVSGSKTSVEKYYSKKDRYYSEGLPEEQGVFSTEQLPPNSIAEPEHIAYSHRLCHVTFISVSNGNKYSKDLPLFSWTHSSVDFDNYVYPTKITQLPATKGYNVSIVKEPGFIGGDIGKNNGQILGKYKVNVEDVSQKYRFRVRYATETEGELGIKIDGRTVNLYQYKKTKAPGDPLTYKAFDYLSFSTPVKFNNASSTIELFLQNKTSGTFYLAGIEIIPVKSNYEEELTLEEAKKAVSSLFTDARNALKIDVTDYQIDQAANLVECISGDLYAKEKIVLLRAVKFAKQLSQSQNLLSDPEFNNVNRENSWTASTSVAIIEGDPLYKGRAVQLSSARDENFPTYLYQKIDESTLKPYTRYQLRGFVEGSENLDVYLIRYGAAHVRMNVPYNLEIIDTSSPVNPCEEVDGLSHRSCNVFDRCKQSISVAPDANTGPDQIDGDPHAFSFHIDTGTVDSTENLGIWVAFKISELDGSAIFGNLELIEVGPLSGEALAQVQRKEEKWKQVLAKKRETTAQTVCSGEASQLTNSSQILKIRNYDLIQNFRIFSLRNTLSIKFKIYTITNYPYSRLNYDLFMELENRIQNASLYMTSNILQNGGFKSDVTSWETTANAEVQQIDGASVLVLSNWNASVAQSVNVQNDHGYVLRVTAKKEGIGNGYVTILDCANHIDTLTFSACRSDSDTSSNELTAYVTKTLEIFPDTEQIRIEIGETEGMFYVESVELIRMEN

SEQ ID NO: 246 - protein, 826 aa, Bacillus thuringiensis higo
MNPYQNKNEYEILDAKRNNCHMSNGYPRHPLANDPQMYLRNAHYKDWLSMCNKNNPVGLIPPESFEWTWLNGTVAALTIVSVIAGILVTAPVSVTAGLITVLGAGAALLAGITPLIWPATTDNTFNKITDATEVLLNKEISEFVRKTANTKIDSLQQLIYYYQNALENWKKNPNDSAARNTVSTRFQIVNAFFVEAMPALSMPGYEVVQLGAYAQAANLHLILLREGIAYADQWNLARDPMHAAGDLHYKEFLDYRNQYINHCSTWYNEGQNEANLKNNGLVYQRTMTLFVLDLIAMFSTYDPRLYTMPIKTEILTRTIYTDGVNRNEPKSIHNPGLFRRLEQMKLHIYEYQGAQFLSGHQNIFRSMNYNHPLIYGPVQGYSSSNINKITTINLGDYDKIYSINTESRNRLVQGSTTFDKINFYGAFNENWLFSVYNQNGPIIKHSNIPGIDAPSTGLNYSNYTHYLSNCIFQSNRNGGSAPDYNTQSYVFGWNHYTIDPTGNYVTDAFEVNKNLPESRYVPQISQVPAVKASDIFNPGRVVNAKVESGPYFTGGDVIVSKAQLDGSGLARTLITFPIIPKRYRASGFRVRMYYAANHTGQVSYGVANINTTGYANFQKTFDGWEYFRARHEHFKYIEFDTTFSLRNSGQLEEHLLHIYYPNTTKISGDQLLIIDKIEFIPVGIPLNQTSEGYNTYDQNTNSYNQNYNNYNQNMDTTYQPNYDNYKQNSSGMYDNPYNQNPKDSYNQNYTDTYDSGYNNSQNVGSNYNQEYNTYNQDTENMYNQSYNNYNSDNNNYNQNSDCMCSPGYNGNYECRCNQRANGNYPK

SEQ ID NO: 247 - protein, 1109 aa, Bacillus thuringiensis finitimus B-1161
MAQTYYKIGVQSTEVNSESIFFNPEVDSSDTVAVVSAGIVVVGTILTAFASFVNPGVVLISFGTLAPVLWPDPEEDPKKIWSQFMKHGEDLLNQTISTAVKEIALAHLNGFKDVLTYYERAFNDWKRNPSANTARLVSQRFENAHFNFVSNMPQLQLPTYDTLLLSCYTEAANLHLNLLHQGVQFADQWNADQPHSPMLKSSGTYYDELLVYIEKYINYCTKTYHKGLNHLKESEKITWDAYNTYRREMTLIVLDLVATFPFYDIRRFPRGVELELTREVYTSLDHLTRPPGLFTWLSDIELYTESVAEGDYLSGIRESKYYTGNQFFTMKNIYGNTNRLSKQLITLLPGEFMTHLSINRPFQTIAGINKLYSLIQKIVFTTFKNDNEYQKNFNVNNQNEPQETTNYPNDYGGSNSQKFKHNLSHFPLIIHKLEFAEYFHSIFALGWTHNSVNSQNLISESVSTQIPLVKAYEVTNNSVIRGPGFTGGDLIELRDKCSIKCKASSLKKYAISLFYAANNAIAVSIDVGDSGAGVLLQPTFSRKGNNNFTIQDLNYKDFQYHTLLVDIELPESEEIHIHLKREDDYEEGVILLIDKLEFKPIDENYTNEMNLEKAKKAVNVLFINATNALKMDVTDYHIDQVANLVECISDDLYAKEKIKFTPCIKFAKQLSQARNLLSDPNFNNLNAENSWTANTGVTIIEGDPLYKGRAIQLSAARDENFPTYLYQKIDESLLKPYTRYQLRGFVEGSQDLELDLVRYGATDIVMNVPGDLEILSYSAPINPCEEIETRLDTTCGALDRCKQSNYVNSAADVRPDQVNGDPHAFSFHIDTGTTDNNRNLGIWIIFKIATPDGYATFGNLELIELGPLSGEALAQVQRKEQKWGKNTTQKREEAAKLYAAAKQTINQLFADSQGTKLRFDTEFSNILSADKLVYKIRDVYSEVLSVIPGLNYDLFMELENRIQNAIDLYDARNTVTNGEFRNGLANWMASSNTEVRQIQAHPCWYSLGWNAQVAQSLNVKPDHGYVLRVTAKKEGIGNGYVTILDCANHIDTLTFSSCDSGFTTSSNELAAYVTKTLEIFPDTDQIRIEIGETRSTFYVESVDLIRMED

SEQ ID NO: 248 - protein, 1128 aa, Bacillus thuringiensis finitimus
MDKHINKIGVQSTEVNSESIFFNPEVDSSDTVAVVSAGIVVVGTILTAFASFVNPGVVLISFGTLAPVLWPDPEEDPKKIWSQFMKHGEDLLNQTISTAVKEIALAHLNGFKDVLTYYERAFNDWKRNPSANTARLVSQRFENAHFNFVSNMPQLQLPTYDTLLLSCYTEAANLHLNLLHQGVQFADQWNADQPHSPMLKSSGTYYDELLVYIEKYINYCTKTYHKGLNHLKESEKITWDAYNTYRREMTLIVLDLVATFPFYDIRRFPRGVELELTREVYTSLDPPGLNAGPIPEIDFSYLEDHLTRPPGLFTWLSDIELYTESVAEGDYLSGIRESKYYTGNQFFTMKNIYGNTNRLSKQLITLLPGEFITHLSINRGFQTIAGINKLYSLIQKIVFTTFKNDNEYQKNFNVNNQNEPQETTNYPNDYGGSNSQKFKHNLSHFPLIIHQVEFAEYFHSIFALGWTHNSVNSQNLISESVSTQIPLVKAYEVTTNSVIRGPGFTGGDLIELRDKCSIKCKASSLKKYAISLFYAANNAIAVSIDVGDSGAGVLLQPTFSRKGNNNFTIQDLNYKDFQYHTLLVDIELPESEEIHIHLKREDDYEEGVILLIDKLEFKPIDENYTNEMNLEKAKKAVNVLFINATNALKMDVTDYHIDQVANLVECISDDLYAKEKIKLLHAIKFAKQLSQARNLLSDPNFNNLNAENSWTANTGVTIIEGDPLYKGRAIQLSAARDENFPTYLYQKIDESLLKPYTRYQLRGFVEGSQDLELDLVRYGATDIVMNVPGDLEILSYSAPINPCEEIETRLDTTCGALDRCKQSNYVNSAADVRPDQVNGDPHAFSFHIDTGTTDNNRNLGIWIIFKIATPDGYATFGNLELIELGPLSGEALAQVQRKEQKWGKNTTQKREEAAKLYAAAKQTINQLFADSQGTKLRFDTEFSNILSADKLVYKIRDVYSEVLSVIPGLNYDLFMELENRIQNAIDLYDARNTVTNGEFRNGLANWMASSNTEVRQIQDTSVLVLSSWNAQVAQSLNVKPDHGYVLRVTAKKEGIGNGYVTILDCANHIDTLTFSSCDSGFTTSSNELAAYVTKTLEIFPDTDQIRIEIGETEGTFYVESVDLIRMED

SEQ ID NO: 249 - protein, 650 aa, Bacillus thuringiensis medellin
MNSFQNKNEYEILNAPSSISNIPNNYSKYPIANTLNQTMQNTNYKDWTNMCAIDNNLKSINPFEANLQNSLVGLFAITAAIASLLSAPITGGTSIAAGTAIAAAIIPILWPSQENNLPDKLLAISEATLYSFQDQRVREDALTRLESLKDSVKYFENAFTFWINNPNSTNTTTVRERFQEVNGRFVGSMAFFRAKNYEPILLSTYAQAARLHLLHLRDGITYAEKWNLSRQGDDMPGDLLYKEFNKYCNEYIEHCIKWYNESLSLLKSVGANWLEYNQYRTFLTASVLDVISLFSSYDPRLYKERLSVEILTRKLYTDPINYHRGISLEADESKYTLEPTLFTQLYTLTFYSNIFYNYMGHTNTYRYLSPDKIFAERSFGKQSSYIDKVPVIPNDKSIIYKIRAYDNHNGLFNVMYFGFWDGEKDQIQKIIGGSSTEIYIKNCTHRLADVISHDLDEKNKCYSFAWTSTTISLENEIKNDIITQIPAVKAYQLGVQSQVIKGPGHTGGDLINLKSNDYLRISCQHLSNVTKKYFVRIRYATNGSLNTRPIINITIPGMTPQGMVLDNTFSGTGYSNLEYQNFGYKEFLKEVTLNPNQSISLTLNRSDQNSNSILLLDRIEFLPITPSIRKSKEQQNLEKNQKTVNKLFFN

SEQ ID NO: 250 - protein, 633 aa, Bacillus thuringiensis kurstaki
MNNVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 251 - protein, 633 aa, Bacillus thuringiensis; identical to SEQ ID NO: 250

SEQ ID NO: 252 - protein, 635 aa, Bacillus thuringiensis
MNNVLNSGKTTICNAYNVVAHDPFSFEHKSLDTIQEEWMEWKRTDHSLYVAPVVGTVSSFLLKKVGSLIGKRILSELWGLIFPSGSTNLMQDILRETEQFLNQRLNTDTLDRVNAELEGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGNRLSTTFPNIGGLPGSTTIHSLNSARVNYSGGVSSGLIGATNLNHNFNCSTVLPPLSTPFVRSWLDSGTDREGVATSTTWQTESFQITSGLRCGAFPFSARGNSNYFPDYFIRNISGVPLVIRNEDLTRPLHYNQIRNIESPSGTPGGLRAYMVSVHNRKNNIYAAHENGTMIHLAPEDYTGFTISPIHATQVNNQTRTFISEKFGNQGDSLRFEQSNTTARYTLRGNGNSYNLYLRVSSIGNSTIRVTINGRVYTASNVNTNTNNDGVNDNGARFSDINIGNVVASDNTNVPLDINVTLNSGTQFELMNIMFVPTNLPPLY

SEQ ID NO: 253 - protein, 633 aa, Bacillus thuringiensis Rpp39
MNNVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMSEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDSTNVTLDINVTLNSGTPFDLMNIMFVPTNLPPLY

SEQ ID NO: 254 - protein, 633 aa, Bacillus thuringiensis 146-158-01
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLIVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 255 - protein, 633 aa, Bacillus thuringiensis HD-550
MNSVLNSGRTTICDAYNVVAHDPFSFEHKSLDTIQKEWMEWKRTDHSLYVAPVVGTVSSFLLKKVGSLFGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNGPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFAPTNLPPLY

SEQ ID NO: 256 - protein, 633 aa, Bacillus thuringiensis kurstaki HD1; identical to SEQ ID NO: 250

SEQ ID NO: 257 - protein, 635 aa, Bacillus thuringiensis sotto
MNNVLNSGKTTICNAYNVVAHDPFSFEHKSLDTIQEEWMEWKRTDHSLYVAPVVGTVSSFLLKKVGSLIGKRILSELWGLIFPSGSTNLMQDILRETEQFLNQRLNTDTLDRVNAELEGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNICLHDMLEFRTYMFLNVFEYVSIWSLFKYQSLMVSSGANLYASGSGPQQTQSFTAQNWPFLYSLFQVNSNYILSGISGNRLSTTFPNIGGLPGSTTIHSLNSARVNYSGGVSSGLIGATNLNHNFNCSTVLPPLSTPFVRSWLDSGTDREGVATSTTWQTESFQITSGLRCGAFPFSARGNSNYFPDYFIRNISGVPLVIRNEDLTRPLHYNQIRNIESPSGTPGGLRAYMVSVHNRKNNIYAAHENGTMIHLAPEDYTGFTISPIHATQVNNQTRTFISEKFGNQGDSLRFEQSNTTARYTLRGNGNSYNLYLRVSSIGNSTIRVTINGRVYTASNVNTNTNNDGVNDNGARFSDINIGNVVASDNTNVPLDINVTLNSGTQFELMNIMFVPTNLPPLY

SEQ ID NO: 258 - protein, 633 aa, Bacillus thuringiensis kenyae HD549
MNSVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGASSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGSSYNLYLRVSSIGNSTIRVTINGRVYTVSNVNTTTNNDGVNDNGARFPDINIGNIVASDNTNVTLDINVTLNSGTPFDLMNIMFVPTNLPPLY

SEQ ID NO: 259 - protein, 633 aa, Bacillus thuringiensis SL39
MNNVLNSRRTTICDAYNVVAHDPFSFEHKSLDTIQKEWMEWKRTDHSLYVAPVVGTVSSFLLKKVGSLIGKRILSELWGIIFPSSSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGGGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARHTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 260 - protein, 633 aa, Bacillus thuringiensis YZ71
MNNVLNSGRTTICDAYNVVAHDPFSFEHKSLDTIQKEWMEWRRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPAPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKDNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNPPPLY

SEQ ID NO: 261 - protein, 551 aa, Bacillus thuringiensis CY29
MNNVLNSRRTTICDAYNVVAHDPFSFEHKSLDTIQKEWMEWKRTDHSLYVAPVVGTVSSFLLKKVGSLIGKRILSELWGIIFPSSSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGGGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARHTLRGNGNSYNLYLRVSS

SEQ ID NO: 262 - protein, 633 aa, Bacillus thuringiensis Dongbei 66
MNNVLNSGRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQGLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLPPLY

SEQ ID NO: 263 - protein, 633 aa, Bacillus thuringiensis; identical to SEQ ID NO: 250

SEQ ID NO: 264 - protein, 633 aa, Bacillus thuringiensis kurstaki HD1
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 265 - protein, 633 aa, Bacillus thuringiensis CMBL-BT1
MNTVLNNGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANSYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 266 - protein, 633 aa, Bacillus thuringiensis LyD
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSFWSVFKYQSLLVSSGANLNARGRGPQQAQSFTSPGWAFLNSLFQVNSNYVFNGFRGARLFNSFPNIIGLPGFTTTHPLLAAKVNYKGRISSGDIGASPVNQNFNCSKFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVARSNSDVSLDINVSLNSRTLIDLMNIMLVPTNISPLY

SEQ ID NO: 267 - protein, 633 aa, Bacillus thuringiensis ywc5-4
MNSVLNIGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYQSDYFIRNISGVPLVVRNEDLRRPLHYNEIRNIASPSGTPGGARAYLVSVHNRKNNIHAVHENGSLIHLAPNDYTGFTISPIHATQVNNQTRTFISEKFGNQGDSLRFEQNNTTARYTLRGNGNSYNLYLRVSSIGNSTIRVTINGRVYTATTVNTTTNNDGVNDNGARFSDINIGNVVASSNSDVPLDINVTLNSGTQFDLMNIMLVPTNISPLY

SEQ ID NO: 268 - protein, 633 aa, Bacillus thuringiensis Bts
MNSVLNTGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQADVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWRTESFETTLGLRSGAFTARGNSNYYSDYFIRNISGVPLVVRNEDLRRPLHYNEIRNIASPSGTPGGARAYLVSVHNRKNNIHAVHENGSLIHLAPNDYTGFTISPIHATQVNNQTRTFISEKFGNQGDSLRFEQNNTTARYTLRGNGNSYNLYLRVSSIGNSTIRVTINGRVYTATTVNTTTNNDGVNDNGARFSNINIGNVVASSNSDVPLDINVTLNSGTQFDLMNTMLVPTNISPLY

SEQ ID NO: 269 - protein, 634 aa, Bacillus thuringiensis BF-4
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSECTSLDINVTLNSGTQFDLMNIMLVPTNISPLY

SEQ ID NO: 270 - protein, 633 aa, Bacillus thuringiensis SK-793; identical to SEQ ID NO: 264

SEQ ID NO: 271 - protein, 633 aa, Bacillus thuringiensis kurstaki HD1; identical to SEQ ID NO: 264

SEQ ID NO: 272 - protein, 633 aa, Bacillus thuringiensis; identical to SEQ ID NO: 264

SEQ ID NO: 273 - protein, 633 aa, Bacillus thuringiensis BTC002; identical to SEQ ID NO: 264

SEQ ID NO: 274 - protein, 633 aa, Bacillus thuringiensis B-Pr-88
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 275 - protein, 633 aa, Bacillus thuringiensis ly30
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTELQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 276 - protein, 633 aa, Bacillus thuringiensis WZ-7
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNGIRNIASPSGTPGGARAYMVSVHNRKNNIHAVHENGSMIHLAPNDYTGFTILPIHATQVNNQTRTFISGKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 277 - protein, 633 aa, Bacillus thuringiensis WB2
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTVRGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 278 - protein, 633 aa, Bacillus thuringiensis LLB6
MNNVLNSGRTTICDAYNVAAHDPFSFQHKSLDTVQKEWTEWKKNNHSLYLDPIVGTVASFLLKKVGSLVGKRILSELRNIIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTKLPPLY

SEQ ID NO: 279 - protein, 622 aa, Bacillus thuringiensis shanghai S1
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANFNLSFIRGVILNADEWGISAATVRTYRDHLRKFHRDYSNYCINPYQTAFRGLNHRLPDMLEFRTYMFLNVFEYVSIWSLFKYQSLLVSSGANLYASGSGPTQSFTAQNWPFLYSLFQVNSNYVLNGLSGARTTITFPNIGGLPVYHNSTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNPTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 280 - protein, 623 aa, Bacillus thuringiensis QCL-1
MNTVLNNGRNTTCHAPNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSDTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 281 - protein, 623 aa, Bacillus thuringiensis HD29
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQSFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFIEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 282 - protein, 623 aa, Bacillus thuringiensis CMBL-BT3
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIRGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASSSGPTQSFTAQNWPFLYSLFQVNSNYVLNGLSGARTTITFPNIGGLPGSTTTQTLHVARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 283 - protein, 623 aa, Bacillus thuringiensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVPVHNRKNNIYATHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 284 - protein, 625 aa, Bacillus thuringiensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNDNPQFELMNIMLFQLIFHHFIKV

SEQ ID NO: 285 - protein, 623 aa, Bacillus thuringiensis WB9
MNSVLNSGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRNYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLYFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNIPPLY

SEQ ID NO: 286 - protein, 623 aa, Bacillus thuringiensis
MNNVLNSGRNTTCHAHNVVAHDPFSFEHKSLNTIEKEWKEWRRTDHSLYVAPIVGTVGSFLLKKVGSLVGKRILSELQNLIFPSGSIDLMQEILRATEQFINQRLNADTLGRVNAELAGLQANVAEFNRQVDNFLNLNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARHTLRGNGNSYNLYLRVSSIGSSTIRVTINGRVYTANVNTTTNNDGVLDNGARFSDINIGNVVASANTNVPLDIQVTFNGNPQFELMNIMFVPTNIPPLY

SEQ ID NO: 287 - protein, 623 aa, Bacillus thuringiensis wuhanensis
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 288 - protein, 623 aa, Bacillus thuringiensis SBSBT-1
MNTVLNNGRNTTCHAHNVVAHDPFSFEHKSLNTIEKEWKEWKRTDHSLYVAPIVGTVGSFLLKKVGSLVGKRILSELQNLIFPGGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 289 - protein, 623 aa, Bacillus thuringiensis CMBL-BT1
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCIDTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFELMNIMFVPTNLPPLY

SEQ ID NO: 290 - protein, 623 aa, Bacillus thuringiensis CMBL-BT2
MNTVLNNGRNTTCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLLVSSGANLYASGSGPTQSFTAQNWPFLYSLFQVNSNYVLNGLSGARTTITFPNIGGLPGSTTTQTLHFARINYRGGVSSSRIGQANLNQNFNISTLFNPLQTPFIRSWLDSGTDREGVATSTNWQSGAFETTLLRFSIFSARGNSNFFPDYFIRNISGVVGTISNADLARPLHFNEIRDIGTTAVASLVTVHNRKNNIYDTHENGTMIHLAPNDYTGFTVSPIHATQVNNQIRTFISEKYGNQGDSLRFELSNTTARYTLRGNGNSYNLYLRVSSIGSSTIRVTINGRVYTANVNTTTNNDGVLDNGARFSDINIGNVVASANTNVPLDIQVTFNGNPQFEFMNIMFVPTNLPPLY

SEQ ID NO: 291 - protein, 633 aa, Bacillus thuringiensis BR30
MNSVLNSGRNTICDAYNVVVHDPFSFQHKSLDTIQKEWMEWKKDNHSLYVDPIVGTVASFLLKKLGSLIGKRILSELRNLIFPSGSTNLMEDILRETEKFLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLSTSFVRSWLDSGSDRQGVNTVTNWQTESFETTSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNISPLY

SEQ ID NO: 292 - protein, 633 aa, Bacillus thuringiensis WB10
MNSVLNSGRTTICDAYNVVVHDPFSFQHKSLDTIQKEWMEWKKDNHSLYVDPIVGTVASFLLKKLGSLIGKRILSELRNLIFPSGSTNLMEDILRETEKFLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGPNFNQNFNCNTISPPLSTSFVRSWLDSGSDRQGVNTVTNWQTESFETTSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNLPPLY

SEQ ID NO: 293 - protein, 633 aa, Bacillus thuringiensis 5_2AcT(1)
MNTVLNNGRNTICDAYNVVVHDPFSFQHKSLDTIQKEWMEWKKDIHSLYVDPIVGTVASFLLKKLGSLIGKRILSELRNLIFPSGSTNLMEDILRETEKLLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLPTSFVRGWLDSGSDRQGVNTVTNWQTESFEATSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNLPPLY

SEQ ID NO: 294 - protein, 633 aa, Bacillus thuringiensis CMBL-BT2
MNTVLNNGRNTICDAYNVVVHDPFSFQHKSLDTIQKEWMEWKKDNHSLYVDPIVGTVASFLLKKLGSLIGKRILSELRNLIFPSGSTNLMEDILRETEKFLNQKLNTDTLSRVNAELTGLQANVEEFNRQVDNFLNPNRNAVPLSITSSVNTMQQLFLNRLSQFQMQGYQLLLLPLFAQAANLHLSFIRDVILNAEEWGISAATLRTYQNHLRNYTRDYSNYCIDTYQTAFRGLNTRLHDMLEFRTYMFLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLSTSFVRSWLDSGSDRQGVNTVTNWQTESFETTSGLRCGAFTPRGNSNYYPGYFIRNISGVSLVLRNEDLKRPLYYNEKRNIESPSGTPGGARAYMVSVHNKKNNIYAVHENGTMIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNLPPLY

SEQ ID NO: 295 - protein, 633 aa, Bacillus thuringiensis HD29
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRSAVPLSITSSVNTMQQLFLNRLPQFQMQGYQLLLLPLFAQAANLHLSFIRDVILNAEEWGISAATLRTYRDYLKNYTRDYSNYCIDTYQTAFRGLNTRLHDMLEFRTYMSLNVFEYVSIWSLFKYQSLLVSSGANLYASGSGPQQTQLFTSQDWPFLYSLFQVNSNYVLSGFSGASLFTTFPNIGGLPGSTTTQALLAARVNYSGGITSGSIGGSNFNQNFNCNTISPPLSTSFVRSWLDSGSDRQGVNTATNWQTESFETTSGLRCGAFTPRGNSNYYPGYFIRNISGVSLVLRNEDLKRPLYYNEKRNIESPSGTPGGARAYMVSVHNKKNNIYAVHENGTTIHLAPEDNTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMLVPTNISPLY

SEQ ID NO: 296 - protein, 632 aa, Bacillus thuringiensis
MNNVLNNGRTTICDAYNVVAHDPFSFEHKSLDTIRKEWMEWKRTDHSLYVAPIVGTVSSFLLKKVGSLIGKRILSELWGLIFPSGSTNLMQDILRETEQFLNQRLNTDTLARVNAELEGLQANIREFNQQVDNFLNPTQNPVPLSITSSVNTMQQLFLNRLPQFRVQGYQLLLLPLFAQAANMHLSFIRDVVLNADEWGISAATLRTYQNYLKNYTTEYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLTQTFPNIGGLPGTTTTHALLAARVNYSGGVSSGDIGAVFNQNFSCSTFLPPLLTPFVRSWLDSGSDRGGVNTVTNWQTESFESTLGLRCGAFTARGNSNYFPDYFIRNISGVPLVVRNEDLRRPLHYNEIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSLGNSTIRVTINGRVYTASNVNTTTNNDGVNDNGARFLDINMGNVVASDNTNVPLDINVTFNSGTQFELMNIMFVPTNLPPIY

SEQ ID NO: 297 - protein, 626 aa, Bacillus thuringiensis C81
MNSVLNSGRTTICDAYNVVAHDPFSFQHKSLDTIQKEWTEWKKNNHSLYVDPIVGTVGSFLLKKVGSLIGKRILSELLNLIFPSGNTNLMQDILRETEKLLNQRLNADTLNRVNAELRGLEANVNEFNRQVDNFLNPNRNAVPLSITSSVNTMQQLFLSRLPQFQIQGYQLLLLPLFAQAANLHLSFIRDVILNADEWGISAATLRTYRDHLRNYTRDYSNYCINTYQTAFRGLNTRLHDMLEFRTYMFLNVLDYVSIWSLFKYQSLLVSSGANLYACGNSPNTQSFTAQDWPFLYSLFQVNSNYILSGLSGSRSTITLPVIGPFPGTTTTQTLHNARINYRGGISSGLIGSSNLNQNFNITPIFNPLLTPFIRSWLDSGIDREGLATTTNWMTGSFETTIGLRFSIFTARGNSNYFPDYFIRNISGVVRDLRNEDLRKPLHFNEIRNIGTTPVSSLVSVHNRKNNIYAVHENGSMIHLMPKDYTGFTISPIHATHVNNQNRTFISEKFGNQGDSLRFEQSNTTARYTFRGNGNSYNLYLRVSSLGNSTIRVTINGRVYTATNVNTTTNNDGVNDNGAHFSDINIGNVVASSNTDVPLDINVTFNSGAQFDLMNIMLVPTNISPLY

SEQ ID NO: 298 - protein, 626 aa, Bacillus thuringiensis SK-758
MNSVLNSGRTTICDAYNVVAHDPFSFQHKSLDTIQKEWTEWKKNNHSLYVDPIVGTVGSFLLKKVGSLIGKRILSELLNLIFPSGDTNLMQDILRETEKLLNQRLNADTLNRVNAELRGLEANVNEFNRQVDNFLNPNRDAVPLSITSSVNTMQQLFLSRLPQFQIQGYQLLLLPLFAQAANLHLSFIRDVILNADEWGISAATLRTYRDHLRNYTRDYSNYCINTYQTAFRGLNTRLHDMLEFRTYMFLNVLDYVSIWSLFKYQSLLVSSGANLYACGNSPNTQSFTAQDWPFLYSLFQVNSNYILSGLSGSRSTITLPVIGPFPGTTTTQTLHNARINYRGGISSGLIGSSNLNQNFNITPIFNPLLTPFIRSWLDSGIDREGLATTTNWMTGSFETTIGLRFSIFTARGNSNYFPDYFIRNISGVVRDLRNEDLRKPLHFNEIRNIGTTPVSSLVSVHNRKNNIYAVHENGSMIHLMPKDYTGFTISPIHATHVNNQNRTFISEKFGNQGDSLRFEQSNTTARYTFRGNGNSYNLYLRVSSLGNSTIRVTINGRVYTATNVNTTTNNDGVNDNGAHFSDINIGNVVASSNTDVPLDINVTFNSGAQFDLMNIMLVPTNISPLY

SEQ ID NO: 299 - protein, 634 aa, Bacillus thuringiensis JF19-2
MNSVLNTGRTTICDAYNVAAHDPFSFQHKSLDTVQKEWTEWKKNNHSLYLDPIVGTVASFLLKKVGSLVGKRILSELRNLIFPSGSTNLMQDILRRDTKNSCIKDLIQTLLPVYMRNWHGLQADVEEFNRQVDNSLNPNRNAVPLSITSSVNTLQHLFLNRLPQFQLQGYQLLLLPLFAQAANLHLSFIRDVILNADEWGISAATLRTYRDYLKNYTRDYSNYCINTYQSAFKGLNTRLHDLLEFRTYLFLNVFEYVSIWSLFKYQSLLVSSGANLSASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDRERVATVTNWRTESFETTLGLRSGAFTARGNSNYYSDYFIRNISGVPLVVRNEDLRRPLHYNEIRNIASPSGTPGGARAYLVSVHNRKNNIHAVHENGSLIHLAPTDYTGFTISPIHATQANNQTRTFISEKFGNQGDSLRFEQNNTTARYTLRGNGNSYNLYLRVSSIGNSTIRVTINGRVYTATTVNTTTNNDGVNDNGARSSNINIGNVVASSNPDVPLDINVTLNSGTQFDLMNTMLVPTNISPLY

SEQ ID NO: 300 - protein, 632 aa, Bacillus thuringiensis SC6H8
MNNVLNSGRATNGDAYNVVAHDPFSFQHKSLDTIQEEWMEWKKDNHILYVDPIVGTVASFLLKKVGSLVEKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNYTREYSNYCITTYQTAFRGLNTRLHDMLEFRTYMFLNVFEYVSIWSLFKYQSLLVSSGANLYASGSGPQQTQSFTSQDWPFLYSLFQVNSNYVLNGFSGARLTQTFPNIVGLPGTTTTHALLAARVNYSGGVSSGDIGAVFNQNFSCSTFLPPLLTPFVRSWLDSGSDRGGINTVTNWQTESFETTLGLRSGAFTARGNSNYFPDYFIRNISGVPLVVRNEDLRRPLHYNQIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASDNTNVPLDINVTLNSGTQFELMNIMFVPTNLPPLY

SEQ ID NO: 301 - protein, 632 aa, Bacillus thuringiensis BRC-ZQL3
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLTQTFPNIVGLPGTTTTHALLAARVNYSGGVSSGDIGAVFNQNFSCSTFLPPLLTPFVRSWLDSGSDRGGINTVTNWQTESFETTLGLRSGAFTARGNSNYFPDYFIRNISGVPLVVRNEDLRRPLHYNQIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASDNTNVPLDINVTLNSGTQFELMNIMFVPTNISPLY

SEQ ID NO: 302 - protein, 688 aa, Bacillus thuringiensis medellin
MNSYENKNEYEILDTSQKNSNMSNRYSKYPLTNNPKVPLQNTNYKDWLNMCQTITPLCTPIDTDSKLVATAIKVIGAIFKSMPGPGAAVGLVLKSFSTIIPILWPNDKTPIWKEFTKQGLQLFRPELGRDAIEIIGNDVQAEYNSLEIMMRDFENKFANWESNRTRANAIAVTTAFSTVNTQIIRLKERFLIAPENRPAFLNLYAQTANIDLILYQRGSVYGDKWVADINNRSTSPFSSKDYYQSLKGKIKDYTNYCAETYRNSLTILKNKPHIQWDIYNRYRREAILGALDLVALFPNYDICIYPTQTRTELTRKVYMPSFYLQALQQRDIETVENQLTHPPSLFTWLNELNLYTIRERFNPVLQVASLSGLQATSRYTQNTTTISNPVQGPVREGTPTKISLANYYIYKLFMSQYRHPNDCLPISGINEMSFYRSDYYGAGGPAPVHYSAGESPTNVIKTYMNGPQNALISNDISINETSHILSDIKMNYSRTGGVYPLYDFGYSFAWTHTSVDPDNLIVPNRITQIPAVKAYSLTSPARVIVGPGHTGGDLVALLNSGTQSGTMQIQCKTGSFTGPSRQYGLRMRYAANSAFTVSLSYTLLGQTRGTSFVTENTFSRSNNIIPTDLKYEEFKYKDYLQIITMTLPANTIITISMQQATGLLNNQLIIDRIEFYPMDQGVVACTVN

SEQ ID NO: 303 - protein, 683 aa, Bacillus thuringiensis entomocidus
MNPYQKKTEYEILDALPNYSNMVNAYSRYPLANNPQVPLQNTSYKDWLNMCQTINPLCTPINIDIDSLAASIAVVGSILALIPGPGEAIGFVLGTFSTILPILWPNGETKIWTDFAERGLQLFRPELGQDAIEILVTGVKSGYNALKNRMENFEQAFTKWKGNRTRSNAEQVIRDFDSVRDKVIDLKNDYMINPENKPAFINLYAQTANIDLILYQRGAVYGDDWEKDINGSISPFWGSKDYYESLKTKIEEYTNYCAETYRNSLNILKNKPNISWDTYNKYRREATLGALDLVALFPNYDMHLYPAATKTELTRKIYMPSFGLQQSNYFQSLEGLENALTHPPSLFTWLNELNLYTVRENFNPALQVSSLSGLQARSRYTQNPTILDNPAQGVRNGTSTQIGLNNLFVYKLSMSQYHHPNDCSSIAGISDMTFYKSDYNGNASATQTYQAGRNTNNVINTFMNGPQKASSSNNISIKQTKHILSDIKMIYFRTGGMYQVYDFGYSFAWTHTSVDPDNLIVPNRITQIPAVKALGISTDSKVVKGPVFIGGDLLLLKLQATIRIKTDHANTRYKIRVRYASNANTPIVLSSLQNTLTVTFPQTITHSTISELQYKDFQYVTFPGEFIMDKPSIDVAIRGVQNDRNDIWIDRIEFLPITQSVLDYTEEQNIEKSQKAVNDLFIN

SEQ ID NO: 304 - protein, 688 aa, Bacillus thuringiensis sotto
MNLYGNKNDSEILNASSNNSNMSTTYPKYPLAHSRQDSMENMNYKEWINQCETINTFCTPIDTDINSVAATIGAVGAILALIPGPGEAIGFVLSTFTSLIPYLWPSDTKKIWGDFTKQGLQLFRPELGNDAIEIIGNDVQSEYNSLKTFMQNFEDSFTDWKKYRNRATAVAVTNDFSSVRDQIIRLKDRFLINPENKPAFLILYAQTANFDLILYQRGALYADEWENDINRSISPLLGSKDYYISLAAKIKEYTNYCAETYRNSLNILKNKTNISWGTYNKYRREVTLGALDLAALFPNYDICIYPIQTKTELTRKVYMPSFGLQQSNYFQSLEGLENALTHPPSLFTWLNELNLYTIRENFNPALLVSSLSGLQAISRYTQNPNRISNPAQGVRNGTPTQIGLNNLFVYKLSLSQYHHPNECYSIAGISDMTFYKSDYNGNAPTTQTYQAGRNSNNFINTFMNGPQEASSSNNISIKQTNHILSDIKMIYSRTGGTYPSYDFGYSFAWTHTSVNPDNLIVPNRITQIPAVKADYLTSPAKVIAGPGHTGGDLVALLNAATQAGRMQIQCKTGSFTGASRRYGIRIRYAANNALTVSLSYTVQGGNTMSTTFITERTFLRPNNTIPTDLKYEEFKYKEYNQIITMTAPQNTIVTIAIQQLNAFPNDQLIIDRIEFYPMDQGVVPCTVN

SEQ ID NO: 305 - protein, 688 aa, Bacillus thuringiensis jegathesan 367
MNLYGNKNDSEILNASSNNSNMSTTYPKYPLAHSRQDSMQNMNYKEWINQCETINTFCTPINIDINSVAATIGAVGAILALIPGPGEAIGFVLSTFTSLIPYLWPSDTKKIWGDFTKQGLQLFRPELGNDAIEILGNDVQSEYNSLKTFMQNFEKSFAAWKIKRDRATAVAVTNDFSSVRDQIIRLKDRFLINPENKPAFLILYAQTANFDLILYQRGALYADEWENDINRSISPLLGSKDYYISLAAKIKEYTNYCAETYRNSLDILKNKPNISWDTYNKYRREVTLGALDLAALFPNYDICIYPIQTKTELTRRVYMPSFGLQQSNYFQSLEGLENALTHPPSLFTWLNELNLYTIRENFNPALLVSSLSGLQAISRYTQNPNRISNPDQGVRTGTPTQIGLNNLFVYKLSLSQYHHPNECYSIAGISDMTFYKSDYNGNAPTTQTYQAGRNSNNFINTFMNGPQEASSSNNISIKQTNHILSDIKMIYSRTGGTYPSSDFGYSFAWTHTSVNPDNLIVPNRITQIPAVKADYLTSPAKVIAGPGHTGGDLVALLNAATQAGRMQIQCKTGSFTGASRRYGIRIRYAANNALTVSLSYTVQGGNTMGTTFITERTFLRPNNTIPTDLKYEEFKYKEYNQIITMTAPQNTIVTIAIQQLNAFPNDQLIIDRIEFYPMDQGVVPCTVN

SEQ ID NO: 306 - protein, 684 aa, Bacillus thuringiensis Y41
MNPYQNTNECEILDDLPNYSKMVNAYSRYPLANNPEVPLQNTSYKDWLNMCQTITPLCTPIDSDINSIAAAIGVIGSILGLIPGPGEAIGLILGTFSSIIPFLWPENKSIIWEEFTHRGLHLIRPELTPTEIEIIVTPLKGYYNALREQLENFESEFAKWALEKSPANTRDVVLRFSAIDAAIINLKNQLIVDVRNKPAFLSLYAQTANIDLILFQRGDKYGDEWVKYARNQPIPFKTSQEYYNSLKDKIENYTNDIAETYRNGLNIIKNIPKISWDVFNLYRREMTLSALDLVALFLNYDIYRYPISTKTELTRKVYMSSFYLQALEQNESLESLENKPLPHSPSLFTWLKRLNLYTISEDYSIPLRVSSLSGLSAVYSHTHQQQALYTRPYQGVLVGQPQEIRFDGFVYKLFMSQNISPNSCYLIGGIPQMSFYISDYSGGLRPNKDYYSASASIYFINSYMNGPQNATKSNNISIRETKHILSDIKMNYSKTGGFYPFHTFGYSFAWTHTSVDPDNLIVPNRITQIPAVKAHYLSATAKVIAGPGHTGGDLVALINDGSRTGSMNIECKTGSFTQPSRRFGLRMRYAENNQFSVSILRDNQGVGTFNIERTFSRTNNIIPTDLKYNEFKYNNYDEITMDLPPNKIIDIRIQQTNSLSINQFIIDRIEFYPIDQGVEACKMQ

SEQ ID NO: 307 - protein, 684 aa, Bacillus thuringiensis aizawai BUN1-14
MNPYQNTNECEILDASPNYSKMGNAYSRYPLANNPQVPLQNTSYKDWLNMCQTITPLCTPIDPDINSVAAAIGVIGSIIGLIPGPGEAIGLILGTFSSIIPFLWPENKTIIWEEFTHRGLHLIRPELTPTEIEIIVNPLKGYYNALREQLENFESEFAIWARNKNAATTGDVLRRFSNIDADIIRLKHQLTVDVRNKPALLSLYAQTANIDLILFQRGAKYGDEWARYARNQPIPFKTSQEYYDSLKEKIENYTNDIAATYRNGLNIIKNIPKISWDVFNLYRREMTLSALDLVALFPNYDICRYPISTKTELTRKVYMSSFYLQALELNESLESLENKLTHPPSLFTWLKRLNLYTISENYSSPLRVSSLSGLSAVYSHTHQQQALYVGPPQGITGGSPQEIRFDGFVYKLFMSQNISPNGCYPIGGIPQMSFYISDYSGSPRPNKDYYSASAIQYISINSYMNGPQNATKSNNISIRETKHILSDIKMNYSQTGGFYPFHSFGYSFAWTHTSVDPDNLIVPNRITQIPAVKAHILSTTAKVIAGPGHTGGDLVALLNDDPRIGTMSIECKTGSFTQPSRRYGLRMRYAANNQFSVSISRNDQGVASFVTERTFSRTNNIIPTDLKYNEFKYNNYDQIIMDLPPNTIINIGIRQTNALSINQFIIDRIEFYPMDQGVEACKMQ

SEQ ID NO: 308 - protein, 688 aa, Bacillus thuringiensis S2160-1
MNSYQNTNEYEILDASQKNSTMSNRYPRCPLANNPQVPLQNTSYKDWLNMCQTITPLCTPVETVSDYVAAFIGVPGSIFGAMPGPGAAVGLFLSSFSTIIPILWPNDTTPIWKEFTKQGLQLFRPELGRDAIEIIGNDVQAEYNALKTMMQDFETKFATWDLNRTRANAIAATTEFNSVKNQIIRLQERFLIAAENRPAFLNLYAQTANIDLILYQRGAANGDKWLEDINNRSISPFSSKDYYQDLKLKIKNYTNYCAETYRNSLNILKNKSDIQWSIYNGYRRVATLGALDLVALFPNYDICIYPIQTQTELTRKVYMPSFYSERLPKGNIETWENSLTHPPSLFTWLKKLDPYTKSERFNPALEVASLCGLHAALSYTPQNGPEFAGPFQGILGTKTTPLISFDNQFVYELFLTQYRHPNDCYSISGKPKITFYISDYYGNSRPNKEYSSNIQLSSVITSYMNGPQNASTSNNISIKQTKHILSDIKMIYTQIGGIYPSHDFGYSFAWTHTSVDPDNLIVPNRITQIPAVKAYSLTSPARVIAGPGHTGGDLVALLNNNLEAGRMQIQCKTGSFTGASRRYGLRMRYAANSQFTVNLSYVLSGTTYGTSFITESTFSRLNNIIPTDLKYEEFKYKEYSQIITMTLPANTIITISIQQAVASSNYQLIIDRIELYPMDQDVVACTVN

SEQ ID NO: 309 - protein, 688 aa, Bacillus thuringiensis Ywc2-8
MNSYQNTNEYEILDASQKNSTMSNRYPRCPLANNPQVPLQNTSYKDWLNMCQTITPLCTPVETDSDYVAAFIGVLGSIFGAMPGPGAAVGLFLSSFSTIIPILWPNDTTPIWKEFTKQGLQLFRPELGRDAIEIIGNDVQAEYNALKTMMQDFETKFATWDLNRTRANAIAVTTEFNSVKNQIIRLQERFLIAAENRPAFLNLYAQTANIDLILYQRGAANGDKWLEDINNRSISPFSSKDYYQDLKLKIKNYTNYCAETYRNSLNILKNKSDIQWSIYNGYRRVATLGALDLVALFPNYDICIYPIQTQTELTRKVYMPSFYSERLPKGNIETWENSLTHPPSLFTWLKKLDPYTKSERFNPALEVASLCGLHAALSYTPQNGPEFAGPFQGILGTKTTPLISFDNQFVYKLFLTQYRHPNDCYSISGIPKITFYISDYYGNSRPNKEYSSNIQLSSVITSYMNGPQNASTSNNISIKQTKHILSDIKIIYTQIGGIYPSHDFGYSFAWTHTSVDPDNLIVPNRITQIPAVKAYSLTSPARVIAGPGHTGGDLVALLNNNLEAGRMQIQCKTGSLTGASRRYGLRMRYAANSQFTVNLSYVLSGTTYGTSFITESTFSRLNNIIPTDLKYEEFKYKEYSQIITMTLPANTIITISIQQAVASSNYQLIIDRIEFYPMDQGVVACTVN

SEQ ID NO: 310 - protein, 687 aa, Bacillus thuringiensis MC28
MKPYQSENEYEILDTLPKYSNIVNVYSRYPLANNPQVPLQNTSYKDWLNMCQTITPLCTPIDIDSKLVATAIGILGAIFKAMPGPGSAVGLFLKTFSTIIPILWPNDNTPIWKEFTKQGLQLFRPELGRDAIEIIGNDVQSGFNALKDHMNDFETKFEIWDKDRTQTNATYLITAFGVVNGKIIDLKNQFLINPANQPAFLNLYAQTANIDLILYQRGAVYGDDWAKAINDSSISPFNSSQIFYDSLKAKIKEYTNYCAETYRNSLTILKNQPNIQWDIYNRYRREATLGALDLVALFPNYDICKYPISTKTELTRKVYMPSFYLQALQHSNIETLENQLTHPPSLFTWLNELNLYTIRENFNPALQVSSLSGLQAKYRYTQNSTILPNPPAQGITNGTPIPIIGLNNLFIYKLSMSQYRHPNDCVPIAGISDMTFYKSDYNGNASATQTYQAGRNSNNVIDTFMNGPQNASSSNNISINQTNHILSDIKMNYARSGGVYDFGYSFAWTHTSVDLDNLIVPNRITQIPAVKANFLSSPARVIAGPGHTGGDLVALLNGGTQAGKMQIQCKTGSSTGASRRYGIRMRYAANNAFTVSLSYTLQGGNTIGTTFITERTFSRPNNIIPTDLKYEEFKYKEYNQIITVTSPQNTIVTIAIRQLNPIPNDQLIIDRIEFYPVDQDAFACPVN

SEQ ID NO: 311 - protein, 664 aa, Bacillus thuringiensis HS18-1
MNLYQNENEYKILDVLPNYSNMVNAYSSYPLANNPQVPLQNTSYKDWLNMCQTITPLCTTIDSDINSVAAAIGVIASIIGLIRGPGEAIGLILGTFSSIIPFLWPENKTIIWEEFTHRGLNLIRPELTPAEIEIILNPLKGSYNALREQLVNFEREFAIWAGAKNQATTGDLLRRISAIEGAIIQLKNQLTVSEANKPALLSLYAQTANIDLILFQRGAKYGDEWAKYARNQPIPFKTSREYYASLIEKIKTYTNDIAGTYRNGLNKIKNIQNISWDTFNEYRRGMTLSALDLVALFPNYDICIYPIQTKTELTRKIYMPSFYLQALQQSGNLESLENQLTHPPSLFTWLNELNLYTISENFNPAILPNPAQGITGGTPIPIGLNNLFIYKLSMSQYHDPNGCYPIAGISDMTFYKSDYNGNASTTQPYHAGRNSNNVIDTFMNGPQNASSSNNISIKETKHILSDIKMVYSRSGVYSLGYSFAWTCTSVNPDNLIVPNRITQIPAVKANLLNSPARVIAGPGHTGGDLVALLNSGTQSGRMEIKCKTGSFTETSRRYGIRMRYAANNAFTVSLSYTLQGGNPIGITFGTERTFLRTNNIIPTDLKYEEFKYKEYNQIITMTAPQNTIVTIAVYQSTPSLNNQLIIDRIEFYPMDQGVEACKMN

SEQ ID NO: 312 - protein, 664 aa, Bacillus thuringiensis S2160-1
MNLYQNENEYKILDVLPNYSNMVNAYSRYPLANNPQVPLQNTSYKDWLNMCQTITPLCTTIDSDINSVAAAIGVIASIIGLIRGPGEAIGLILGTFSSIIPFLWPENKTIIWEEFTHRGLNLIRPELTPAEIEIILNPLKGSYNALREQLVNFEREFAIWAGAKNQATTGDLLRRISAIEGAIIQLKNQLTVSEANKPALLSLYAQTANIDLILFQRGAKYGDEWAKYARNQPIPFKTSREYYASLTEKIKTYTNDIAGTYRNGLNKIKNIQNISWDTFNEYRREMTLSALDLVALFPNYDICIYPIQTKTELTRKIYMPSFYLQALQQSGNLESLENQLTHPPSLFTWLNELNLYTISENFNPAILPNPAQGITGGTPIPIGLNNLFIYKLSMSQYHDPNGCYPIAGISDMTFYKSDYNGNASTTQPYHAGRNSNNVIDTFMNGPQNASSSNNISIKETKHILSDIKMVYSRSGVYSFGYSFAWTYTSVDPDNLIVPNRITQIPAVKANLLNSPARVIAGPGHTGGDLVALLNSGTQSGRMEIKCKTGSFTGASRRYGIRMRYAANNAFTVSLSYTLQGGNPIGITFGTERTFLRTNNIIPTDLKYEEFKYKEYNQIITMTAPQNTIVTIAVYQSTPSLNNQLIIDRIEFYPMDQGVEACKMN

SEQ ID NO: 313 - protein, 723 aa, Bacillus thuringiensis 84-HS-1-11
MDPFSNYSEQKYPDSNNNQELITKSSSFYSDTTNENAKNYHPIEQDILKFTNQEFSDNHYQHSDVSNDINSMRNTLCKDLPPETNMSIYDNLRSTVTVPSFSNQFDPIKFLHDIEIAIQTGSFSALTQSNMNQGGTDINPMLISTFFKVASSLLPFPLSSLGALASFYVTDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFYIYESDWKVRATYVNDYIGKRGSNTGLAWGMWSSDPSVIYTSALGAAGYAPNVVGVRYSHGGSYTKGMAPPNTNAYAPFEFKYPGYKLHSVSAYGLSKAPDTADSVMFGFRPVLLENEANQLLTDTALQIPAEIGITDVVPAFGRTEEPINGQDAIIIWESFTSGFGFTYTVDSPQKQKYKIIYRIANNLSASTVSLTYNNQTFFTDILNTSLDPNGVRGNYGSYTLVEGPIIEFSQGTNIFKLRSQKGEFAIDSIIFSPVS

SEQ ID NO: 314 - protein, 742 aa, Bacillus thuringiensis M15
MDPFSNYSEQKYPDSNNNQELITESSSFYSDTTNENMKTYHPIEQDILKFANQEFPDNYYQHSDVSNSYQNMKTEIVNTDLPYNTNNINSMRNTLCRDLPPETNMSIYDNLRSTVTVPSFSNQFDPIKFLHDIEIAIETGSFSALTQSNMNQGGTDIAPMLISTFFKVAGSLLPFPLSSLGALASFYVTDSQTGAMANLWRQMVDYVEKRIDSKILDYHNFIMGAELAALNASLKEYARVVKIFENDMNRIAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNKVAKYKRGMAMSALSLAALFPTFGPNYPKQALKVVQSRQIFAPVIGIPGGITSQDSGPTFGSMRFDVKTYDQIDALRQLMELYIQPLKSAYFWIYESDWKVRATYVNDYIGKRGSNTGAAWHMWSSDPSAIYTSALGAAGYAPNVVGVRYSHGGSYTKGMAPANTNAYAPFEFKYPGYKLHSVSAYGLSKAPDAADSVMFGFRPVLLENEANQLLTDTALQIPAEIGITDVVPAFGRTEEPINGQDAIRIWESFTSGFGFTYTVDSPQKQKYKIIYRIANNLSASTVSLTYNNQTFFTDILNTSLDPNGVRGNYGSYTLVEGPIIEFSQGTNIFKLGSQKGEFAIDSIIFSPVV

SEQ ID NO: 315 - protein, 723 aa, Bacillus thuringiensis B0195; identical to SEQ ID NO: 313

SEQ ID NO: 316 - protein, 723 aa, Bacillus thuringiensis 79-25
MDPFSNYSEQKYPDSNNNQELITKSSSFYSDTTNENAKNYHPIEQDILKFTNQEFSDNHYQHSDVSNDINSMRNTLCKDLPPETNMSIYDNLRSTVTVPSFSNQFDPIKFLHDIEIAIQTGSFSALTQSNMNQGGTDINPMLISTFFKVASSLLPFPLSSLGALASFYVTDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFYIYESDWKVRATYVNDYIGKRGSNTGLAWGMWSSDPSVIYTSALGAAGYAPNVVGVRYSHGGSYTKGMAPPNTNAYAPFEFKYPGYKLHSVSAYGLSKAPDTADSVMFGFRPVLLENEANQLLTDTALQIPAEIGITDVVPAFGRTEEPINGQDAIIIWESFTSGFGFTYTVDSPQKQKYKIIYRIANNLSASTVSLTYNNQTFFTDILNTSLDPNGVRGNYGSYTLVEGPIMEFSQGTNIFRLRSQKGEFAIDSIIFSPVS

SEQ ID NO: 317 - protein, 723 aa, Bacillus thuringiensis 92-10
MDPFSNYSEQKYPDSNNNQELITKSSSFYSDTTNENAKNYHPIEQDILKFTNQEFSDNHYQHSDVSNDINSMRNTLCKDLPPETNMSIYDNLRSTVTVPSFSNQFDPIKFLHDIEIAIQTGSFSALTQSNMNQGGTDINPMLISTFFKVASSLLPFPLSSLGALASFYVTDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISILRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFWIYESDWKVRATYVNDYIGKRGSNTGAAWHMWSSDPSVIYTSALGAAGYAPNVVGVRYSHGGSYTKGMAPPNTNAYAPFEFKYPGYKLHSVSAYGLSKAPDAADSVMFGFRPVLLENEANQLLTDTALQIPAEIGITDVVPAFGRTEEPINGQDAIIIWESFTSGFGFTYTVDSPQKQKYKIIYRIANNLSASTVSLTYNNQTFFTDILNTSLDPNGVRGNYGSYTLVEGPIIEFSQGTNIFKLRSQKGEFAIDSIIFSPVS

SEQ ID NO: 318 - protein, 754 aa, Bacillus thuringiensis M019
MSVVYHVKGGDIVDPFSNYSAQKYPDSNNNQELTTKSSLFYSDTTNGNVKNYHPIEQDILKFTNQEFSDNSYRHSDVSNSYENKKKEIINIDLPYNTNDINSMRNTLCRDLPPETNMSIYDNLRSAVTVPSFSNQFDPIKFLHDIEIAIQTGSFSALTQSNMNQGGTDINPMLISTFFKVASSLLPFPLSSLGALASFYITDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPVRAQACVMHLMLLKDATTSVWGQQIDSQQLNGYKAELIRLIKVYTNDVNTTYNQGLELEKAKPLNYSDPEEYLQAGRPDISVLRSNFREVMKWNRVAKYKRGMAMSALSLAALFPTFGPNYPKQALKVVQSRQIFAPVIGIPGGITSQDSGPTFGSMRFDVKTYDQIDALRQLMELYIQPLKSAYFWIYESDWKVRATYVNDYIGKRGSNTGAAWHMWSSDPSAIYTSALGAAGYAPNVVGVRYSNGGSYTKGMAPANTNAYAPFEFKYPGYKLHSVSAYGLSKAPDAADSVMFGFRPVLLENEANQLLTDTALQIPAEIGITDVVPAFGRTEEPINGQDAIRIWESFTTGLGFTYTVDSPQKQKYKIIYRIANNLSASTVSLTYNNQTFFTDILNTSLDPNGVRGNYGSYTLVEGPIIEFSQGTNIFKLRSQKGEFAIDSIIFSPVV

SEQ ID NO: 319 - protein, 726 aa, Bacillus thuringiensis B0195
MEKFSNFSEQKYPDSNNNQELTVESSSFYSNTINENVKNHHPIEQDILKFTNQEFSDNHYQHSDVSNDINSMRNTLCRDLPPETNMSIYDNLRSTVTVPSFSNQFDPIKFLHDIEIAIQTGSFSALTQSNMNQGGTDINPMLISTFFKVASSLLPFPLSSLGALASFYITDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVKTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFWIYESDWKVRATYVNDYIGKRGSDTGAAWHMWSSDPSVIYTSALGAAGYAPNVVGVRYSHGGSYTKGMAPANTNAYAPFEFKYPGYKLHSVSAYGLSKAPNAADSVMFGFRPVLLENEANQLLTDTALQIPAEITEKIPNVSLDNYLVEETINGQNAIQLWEPTFPGDPKNRFNYTINSPREQNYKIIYRIASNEPAQISLTYNSKFLTDIPNTSLDPNGVKGNYGFYTLIEGPIIRFSSGTNIFSIRSEINTFAIDSIIFSPVS

SEQ ID NO: 320 - protein, 726 aa, Bacillus thuringiensis 31-5
MDPFSNYSEQKYPDSNNNQELTVESSSFYSNTINENVKNHHPIEQDILKFTNQEFSDNHYQHSDVSNDINSMRNTLCRDLPPETNMSIYDNLRSTVTVPSFSNQFDPIKFLHDIEIAIQTGSFSALTQSNMNQGGTDINPMLISTFFKVASSLLPFPLSSLGALASFYITDSQTGAMANLWRQMVDYVEKRIDSKILDYHNFIMGAELAALNASLKEYARVVKIFENDMNRMAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFWIYESDWKVRATYVNDYIGKRGSDTGAAWHMWSSDPSVIYTSALGAAGYAPNVVGVRYSHGGSYTKGMAPANTNAYAPFEFKYPGYKLHSVSAYGLSKAPNAADSVMFGFRPVLLENEANQLLTDTALQIPAEITEKIPNISLDNYLVEETINGQNAIQLLEPTFPGDPKNRFNYTINSPREQNYKIIYRIASNEPAQISLTYNSKFLTDIPNTSLDPNGVKGNYGSYTLIEGPIIRFSSGTNIFSIRSEINTFAIDSIIFSPVS

SEQ ID NO: 321 - protein, 777 aa, Bacillus thuringiensis 87-29
MDPFSSYSEQKYPDSNNNQELITKSSSFYSDTTNENAKNYHPIEQDILKFTNQEFSDNPYQHSDVSNSYENKKKEIINIDLPYNTNDINSMRNTLCRDLPPETNMSIYDNLRSTVTVPSFSNQFDPIKFLHDIEIAIQTGSFSALTQSNMNQGGTDINPMLISAFFKVAGSLLPFPLSSLGALASFYVTDSQTGAMANLWRQMVDYVEKRIDSKILDYHNFIMGAELAALNASLKEYARVVKIFENDMNRIAEPPSTGVITQFRILHDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFKEVMKWNRVAKYKRGMAMSALSLAALFPTFGPNYPKQALKVVQSRQIFAPVIGIPGGITSQDHSGTFGSMRFDVKTYDQIDALRRLMELYIQPLKSAYFYIYESDWKVRATYVNDYIGKRGSNTGLAWGMWSSDPSVIYTSALGAAGYAPNVVGVRYSHGGSYTKGMAPPNTNAYAPFEFKYPGYKLHSVSAYGLSKAPDAADSVMFGFRPVLLENEANQLLTDTALQIPAEIGITDVVPAFGRTEEPINGQDAIILKKITRGPIPGGSTDCSPWELTHGMCEIDPGPPVPPGPPVPLPHRINYTINSPESGKEYTIWYRLASNQNSLIALQHRISQYDTNISNTQQDTNSVKGNYGYYTLIKGPTLVLFKGENIISLGMLSGEIALDSIIFSPVS

SEQ ID NO: 322 - protein, 633 aa, Bacillus thuringiensis B0462
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTVARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGISNYFPDYFIRNISGVPLVVRNEDLRRPLHYNEIRNIASPSGTPGGARAYMVSVHNRKNNTHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 323 - protein, 758 aa, Bacillus thuringiensis MO19
MSVVYYVKGGDIVDPFSNYSEQKYPDSNNNQELITESSSFYSDTTNENMKTYHPIEQDILKFANQEFPDNYYQHSDVSNSYQNMKTEIVNTDLPYNTNNINSMRNTLCRDLPPETNMSIYDNLRSTVTVPSFSNQFDPIKFLHDIEIAIETGSFSALTQSNMNQGGTDIAPMLISTFFKVAGSLLPFPLSSLGALASFYVTDSQTGAMANLWRQMVDYVEKRIDSKILDYHNFIMGAELAALNASLKEYARVVKIFENDMNRIAEPPSTGVITQFRILNDNFIKYIAKLQFSTNQSDLQYPVLTLPLRAQACVMHLMLLKDATTSVWGQQIDSQQLNGYKAELIRLIKVYTNDVNTTYNQGLELEKAKPLNYSDPEEYLQAGRPDISVLRSNFREVMKWNKVAKYKRGMAMSALSLAALFPTFGPNYPKQALKVVQSRQIFAPVIGIPGGITSQDHSGTFGTMRFDVQTYDQIDALRQLMELYIQPLKSAYFYIYESDGKVRATYVNDYIGKRGSNTGAAWGMWSSDPSAIYTSALGAAGYAPNVVGVRYSNGGSYTKGMAPANTNAYAPFEFKYPGYKLHSVSAYGLSKAPDAADSVMFGFRPVLLENEANQLLTDIALQIPAEIALTRPNLNINQLLVEETINGQNALQLWEPNFPGDSTNIFNYNINSPREQNYKIIYRIASNSPAQISLNYNSKFFLTDIPNTSLDPNGVKGTYGSYTLIEGPIIRFSPGANIFSISSEINTFAIDSIIFSPVS

SEQ ID NO: 324 - protein, 1236 aa, Bacillus thuringiensis yunnanensis
MDPNDHNEYEVMDTGSMGYQPRYPLANAPGAELQQMHYKDWMDMCTYGESVALSEGLRAALFVANSIIGIMLSKIPIVGPIVSTPFQIMGVALPFLWPPNAPEPQFSWESLMTAAEEIADKKIDAQVRANANAELEGVHNAIRLYQDAVCDWKQDPTNAQLKEQLRIQYIATNTVIFSRMPSFRVRGFEVPLLSTYVQAANLHLIHLKDGVQFGEEWGMDSATVDRFYSYLKSDIEIYTNYCIDWYNKGLSDSIESEPTWNGWNTFNNFRRDMTLMVLDLVSIWPTYDPRRYPLPTKSQLTRELYTQAIGSYKSVEPLLPPPSPFRWLREIEFFLRDSQDEAEQFAGFQQGYQYTLDTTIYRPPVVGTRTSLVDSIAMGLGSDDVVYRIKNISHNGWYPKKLDFYYTPSERVESVGEIRTDANNMIDYIGLGCRAKVTEPCDPCTTNCTIDTVNTTASCDNPNLYSHRLSSINPSAPYPGQNGMLSFCYGWTHFSVDDNNLIAADSITQIPAVKAYRIGGYGKVMKGPGYTGGDLMVFYGAGEINWRLTIPDTTKAYRVRARVATIPTSQPVDTVRYNQFEYRDIEVISPTTTVHEYSIGFDITGDDWGLLDKIEFIPIEGPVEAYQADQALEKARKAVNALFTNDAKNALQLKVTDYSVDQAANLIECVSDAFHSQEKMILLDQIKYAKRLSQARNLLNYGDFESSDWSGENGWRTSPHVHVASNHPIFKGRYLHMPGATSSQFSNHIYPTYVYQKVDESKLKSYTRYLVRGFVGNSKDLELLVERYGKDVHVEMDVPNDIRYALPTNECGSLDRCRPASYQARTPHTCTCKDTTSMHTDCQCQNKVNRTSADMYTNGSPSSVMYADGFHAHKSCGCKNNDMYPNGTDSHKSCRCKDPHVFSYHIDTGCVDQEESLGLWFALKIASENGVANIDNLEIIEAQPLTGEALARVKKREQKWKQEMTKKRLETEKAVQAAQSAIQNLFTNAQHNRLKFETLFPQIVHAEKLVEQIPYVHHPFLSGALPTVPGMNFEIIQQLLAVIGNARALYEQRNLVRNGTFSSGTGSWKVTEGVKVQPLQDTSVLVLSEWIHEASQQLHIDPNRGYVLRVTARKEGGGKGTVTMSDCADYTETLTFTSCDFNTSGSQTMTSGTLSGFVTKTLEIFPDTDRIRIDIGETEGTFQVESVELICMEQMEEDLYDIAGNVVEEMRYLDSSRSMGGTLDAMCYTKIGEFGC

SEQ ID NO: 325 - protein, 1270 aa, Bacillus thuringiensis
MNQNDNKNEYEILDSGNLSYQPRYPLANAPGSKLQNMGYKEWRDMCPDAKRQLLKQIGISPFEPDEWTKVGQSLTISAGLVAAIAGVASVAFPPLAIVAGAFAIISMFFDVLWPESENNTNSQVVWADFAAAAEEMMDEKIADEIKAEAVLQLRIVQSRLRDYQQAACNFQSDPNNESYKALLRDAFDDADDALKEVMILFSREGYEQLLLFDYVQAANLHLLLLKDVVRFGVGWGFPPGRVEQYYSNPTNLGNPGMVQLLAKYTNYSTSLCWKGIEERKWMVESEYRSNNEEYYAYRSNMTMMVLDMVALWPTYDPVKYPYATAVELTREIYSLIAGGFRDYKGYMPIQYTWEKPGSLVTNLERFTIYTWKNFEYFPFAGVETTYQTIGTGSSSTKQAGVIPSPEEGTAWTTPGINVEYHLVESFIYGTLTQLLFYDVYNTPAFKAGSDAVEVPGSIAGTPCKNIPLDANDVNVCVPTLWEESPANPEGVCYPYNREMQSNLLSEVIPEDPKLLTLPHVPPLGYIDAFAFAWRSTTCDTRYNLIPANKIGQIPAVKGNWLGQSGSSVVRTSGNTGGDVVRLYEFGNLGMTVRFSENRSYIIRLRYATVADDLNIIVRVQRRGELEYESELPLNQTSNNSTTQWKFEDYGYQEVGGFYPQVGEEYELWFSPVGTELSSHMDIDKIEFIPMETSLEEYLANQDIEKARKAVNALFTGDVKNALKLNVTDYAIDQAANLVECVSEEFYAQEKMILLDQVKVAKRLSQARNLLNYGDFESPEWSRENGWKTSRHVSVRADNPVFKGRYLHMPGVTSPSFSNNTYPTYVYQKVDESKLKSYTRYLVRGFVGNSKDLELLVERYGKDVHVEMDVPHDIRYSLQTNECGGFDRCRPVSYLARSSHACTCKDTASMHTDCQCQNKANRTVTNMYTNVSPGSAMYTDGFHAQKSCGCKNNDMYQNGTHPHKSCGCKDPHVFSYHIDTGCVDPEENLGLWFALKIAGENGVANIDNLEIIEAQPLTGEALARVKKREQRWKQERDKKRLETEKAVQTAQGAIQNLFTNTQQNLLKFETLFPQIVNAEMLVQQIPYVYHPFLSGALPAVAGMNFKIVQQLSATIGNARSLYNQRNLVQNGTFSSGTGSWHVSEGVEVQPLQNTSVLVLSEWSHEASQQVSVDPDRGYVLRVTARKEGVGKGTVTLSDCADYTETLTFTSCDFNTSGSQTMTSGTLSGFVTKTLEIFPDTDRIRIDIGETEGTFKIESVELICMEQMEDDL

SEQ ID NO: 326 - protein, 1254 aa, Bacillus thuringiensis
MNSNYNNEHEILDMNNRSYQTRYPLANAPGVELQQMSYKDWMDRCEQESLAITFKSVITTALDITSAILGAAKSPKAKVARAAVQVLNTVIKLLWPDPEKPSEPAYDIDFIWKELIGRVEILIEEKIDREAYNAAIGRLSGLKRALSLYQESFETWIDDENDPELQEDVRMRFTSTLFELVTTIETFKYSGQELNLLTVFVQAADFHLMLLQQGVMYGVRWGFDQRTVDSFYQNDRGEGLKNLLPKYSDYCTYWYDQGLNRAKNLKANLSDTVRYPWAANLENMSVLQELEDWNLYNDYRRDMTILVLDLVAVWPTYDLHYYDNGNYGVQSELTRSIYSQAVGNVMGTVFTKEQYEVSFVRPPHLVTWLEKMFIQIRPTEQGAPIDATMAGVSLYYSYSGWDNTVDDILLGYPTYSSSEIRVLSKSKVIVQDQEKNRAIYNTDLQHDKLVDRFVFYQNSGEVNYAGRDNPSSYKTFAWDTDITNYSSQMTWINGPVNEGHFGYIQAYAPEWIPASCEPFNNIVDAEDVITQIPAVKARELRYGARVIKGVGNTGGDLVSIAPHGLCELYVSFPNVVRRYQVRIHYACQDPTKINLNIGDSRHDITLPSTYSGGALTYDSFGYATSEYSYLFYADFYDEKQIVRLGNSFDISQQDVIIDKIEFIPVDIFYAEEQDLEKARKAVNALFTNDAKNALQLDVTDYAVDQAANLVECVSDEFHAQEKMILLDQVKFAKRLSQARNLLNYGDFESSDWSGENGWRTSPHVHVASDNPIFKGRYLHMSGAMSPQFSNNIYPTYAYQKVDESKLKSYTRYLVRGFVGNSKDLELLVERYGKDVYVEMDVPNDIRYTLPRNECGDFDRCKPASYQTKPPHTCTCKDPAVAHTDCQCKDKGNHTSTNMYTNGPTGSEVSTNGFHAHKSCGCGDKHMDKSGTHPHKSCGCKDPHVFTYHIDTGCVDTEENLGLFFALKIASENGVANIDNLEIIEAQPLTGEALARVKKREQRWKQEMTKKRLETETAVQAAQDAIQNLFTNTQYNRLKFETLFPHIVNAELLVQQIPYVYHPFLSGALPVVPGMNFDIFQQLSFLIDTAKRLYEARNLVQNGTFSSGTGSWYVTAGVEVHRLQNTSVLVLSEWSHEASQQVRIDSDRGYVLRVTARKEGAGKGTVTLSDCADYTETLSFTSCDYNTVGTQTMTKGTLSGFVTKTLENFPDTDRIRIDIGETEGTFKVESVELICMEQMEDHLYDMAGNLEQDLT

SEQ ID NO: 327 - protein, 1280 aa, Bacillus thuringiensis
MKQNYNDEYDIIDNGGRGDQSRYPLTNAPSAELQDMNYIEWLDNCTLKEQVELFRDTSTTVRDALATTAGIITALLSVSNPAAAATAGIITILIPQLWPSGSDEVTWEKFMAAAEILIQKQITEAVRNKALTELEGVYRTIRLYQLAAERWNQNKNDPQAQESIRTQFRATNTIIEFAMPSFRVAGFEVPLLNVYAEAANLQLALLRDAVKFGRDWGLPQDEVDDIYSEQLLPRIAEHTDHCVTYFNRGLEEAKKLKANLNDYARYPWAQYINHSKIQGIENWNLFNDYRRNMTILVLDLVALWPTYDPRRYSMVTKSELTRELYTSVRGAFYGHNNDYDQNFEEIERNIISPPHLVTWPINFTVYTQNDYYYPMAGLQHKFNYTESIVSLESPVTGVTGTSNLINFVTADPFILAVTIIGFGQLGTSLGIYAMSFGRKSGSISHVGDIEIGTDDYLDIVDRIPVGDSTPNKLSWMSAAPTTLGSTTFLQYVSYAWRHPSVDSNNRISIDKITQIPAVKAFFIDDNHVKVIKGPGSTGGDLVAFSREGYGLSISVFIPGSDLVSFYRVRIRYASSQSAKVTMGFGGGVEESESKFNFPATYSGGNLTYNSFGYINTLAIASQSTAQTIEVYFRQYEEAEFIVDKLEFIPMEMSLEEYQADQDLEKARKAVNALFTSDAKSELKVNITDYAVDQAANLVECVSEDFHAQEKRILLDQVKFAKRLSQARNLLNYGDFESLDWSGENGWRTSPHVHVASDNPIFKGRYLHMPGAMSPQYSNNTYPTYAYQKVDESKLKSYTRYLVRGFVGNSKDLELLVERYGKEVHVEMDVPNDIRSTLPMNECGGFERCGKVSYQAVSDHTCTCKDTARMNTDCQCKDKINHMTTGVYTSMPVGSAMYPDGYHAHKSCKCGDKTMYGNGKHPHKSCGCKDPHVFSYHIDTGCVDQEENLGLWFALKIASENGVANIDNLEIIEALPLTGEALARVKKREHKWKQEMEQKRCKTEEAVQAAQTAINTLFTNTQYNRLKFETLFPHILHADELVQRIPYVYHPFLLGAYPDVPGMNYDIFQQLSALVNQARGLYDMRNLVRNGTFSAGIGNWQVTDGVATQPEGNTSVLILREWSDKAIQHLRIHAERGYVLRVTARKEGNGDGYVVIHDCDNQQEKLTFTACDYTTMGSSTGTQTMMTSPTNCMPCNSTTWKEEMKALVPMLSGYVTKTAEIFPDTDRIHIEIGETEGTFKIESVELICMEHMEEHAYDMEGDIEANIPPIVRPPIMPPTNV

SEQ ID NO: 328 - protein, 310 aa, Bacillus thuringiensis dakota
MAIIDFNQKIKDFCQWQVSNEFNPGRDLRNWVISYENTNISAVPRGASGGVATVNVTPVLKVASTQELYNGSSVTQSQTARFSETTQETQSSTTTEGARFSSTVTSTTKFTANVNFKAIGSGIDQTIAVAVTGEYNYSSSQTITTQRTRVWDVTQPVIVPPRTRIVATLLIYDAPFSIPIDLNCEVTGKIPINNGFSQDLAGATYDYTIGTNTRASSYTRLGMMAYYNWPGKVPEFVGYQSAGRAAFATLVYRGVGLQTAVQGLYSVVKFEEFPIGRQGETRTYYSPIQLADQNTSLAPDSNTIPIINPM

SEQ ID NO: 329 - protein, 119 aa, Bacillus thuringiensis PS80JJ1
MSAREVHIEINNKTRHTLQLEDKTKLSGGRWRTSPTNVARDTIKTFVAESHGFMTGVEGIIYFSVNGDAEISLHFDNPYIGSNKCDGSSDKPEYEVITQSGSGDKSHVTYTIQTVSLRL

SEQ ID NO: 330 - protein, 119 aa, Bacillus thuringiensis EG5899; identical to SEQ ID NO: 329

SEQ ID NO: 331 - protein, 119 aa, Bacillus thuringiensis PS69Q; identical to SEQ ID NO: 329

SEQ ID NO: 332 - protein, 119 aa, Bacillus thuringiensis PS185GG; identical to SEQ ID NO: 329

SEQ ID NO: 333 - protein, 123 aa, Bacillus thuringiensis PS149B1
MSAREVHIDVNNKTGHTLQLEDKTKLDGGRWRTSPTNVANDQIKTFVAESNGFMTGTEGTIYYSINGEAEISLYFDNPFAGSNKYDGHSNKSQYEIITQGGSGNQSHVTYTIQTTSSRYGHKS

SEQ ID NO: 334 - protein, 123 aa, Bacillus thuringiensis PS167H2
MSAREVHIDVNNKTGHTLQLEDKTKLDGGRWRTSPTNVANDQIKTFVAESHGFMTGTEGTIYYSINGEAEISLYFDNPYSGSNKYDGHSNKNQYEVITQGGSGNQSHVTYTIQTVSSRYGNNS

SEQ ID NO: 335 - protein, 123 aa, Bacillus thuringiensis EG9444
MSAREVHINVNNKTGHTLQLEDKTKLDGGRWRTSPTNVANDQIKTFVAESHGFMTGTEGHIYYSINGEAEISLYFDNPYSGSNKYDGHSNKPQYEVTTQGGSGNQSHVTYTIQTASSRYGNNS

SEQ ID NO: 336 - protein, 123 aa, Bacillus thuringiensis KR1369
MSAREVHIDVNNKTGHTLQLEDKTKLDGGRWRTSPTNVANDQIKTFVAESHGFMTGTEGTIYYSINGEAEISLYFDNPYSGSNKYDGHSNKPQYEVTTQGGSGNQSHVTYTIQTASSRYGNNS

SEQ ID NO: 337 - protein, 132 aa, Bacillus thuringiensis EG4851
MSAREVHIEIINHTGHTLQMDKRTRLAHGEWIITPVNVPNNSSDLFQAGSDGVLTGVEGIIIYTINGEIEITLHFDNPYAGSNKYSGRSSDDDYKVITEARAEHRANNHDHVTYTVQRNISRYTNKLCSNNS

SEQ ID NO: 338 - protein, 132 aa, Bacillus thuringiensis PS201L3
MSAREVHIEIINHTGHTLQMDKRTRLAHGEWIITPVNVPNNSSDLFQAGSDGVLTGVEGIIIYTINGEIEIPLHFDNPYAGSNKYSGRSSDDDYKVITEARAEHRANNHDHVTYTVQRNISRYTNKLCSNNS

SEQ ID NO: 339 - protein, 132 aa, Bacillus thuringiensis PS201HH2; identical to SEQ ID NO: 337

SEQ ID NO: 340 - protein, 385 aa, Bacillus thuringiensis PS80JJ1
MLDTNKVYEISNLANGLYTSTYLSLDDSGVSLMSKKDEDIDDYNLKWFLFPIDNNQYIITSYGANNCKVWNVKNDKINVSTYSSTNSVQKWQIKAKDSSYIIQSDNGKVLTAGVGQSLGIVRLTDEFPENSNQQWNLTPVQTIQLPQKPKIDEKLKDHPEYSETGNINPKTTPQLMGWTLVPCIMVNDSKIDKNTQIKTTPYYIFKKYKYWNLAKGSNVSLLPHQKRSYDYEWGTEKNQKTTIINTVGLQINIDSGMKFEVPEVGGGTEDIKTQLTEELKVEYSTETKIMTKYQEHSEIDNPTNQPMNSIGLLIYTSLELYRYNGTEIKIMDIETSDHDTYTLTSYPNHKEALLLLTNHSYEEVEEITKIPKHTLIKLKKHYFKK

SEQ ID NO: 341 - protein, 385 aa, Bacillus thuringiensis EG5899
MLDTNKVYEISNLANGLYTSTYLSLDDSGVSLMSKKDEDIDDYNLKWFLFPIDNNQYIITSYGANNCKVWNVKNDKINVSTYSSTNSVQKWQIKAKDSSYIIQSDNGKVLTAGVGESLGIVRLTDEFPENSNQQWNLTPVQTIQLPQKPKIDEKLKDHPEYSETGNINPKTTPQLMGWTLVPCIMVNDSGIDKNTQIKTTPYYIFKKYKYWNLAKGSNVSLLPHQKRSYDYEWGTEKNQKTSIINTVGLQINIDSGMKFEVPEVGGGTEDIKTQLTEELKVEYSTETKIMTKYQEHSEIDNPTNQPMNSIGLLIYTSLELYRYNGTEIKIMDIETSDHDTYTLTSYPNHKEALLLLTNHSYEEVEEITKIPKHTLIKLKKHYFKK

SEQ ID NO: 342 - protein, 385 aa, Bacillus thuringiensis PS69Q; identical to SEQ ID NO: 341

SEQ ID NO: 343 - protein, 385 aa, Bacillus thuringiensis PS185GG; identical to SEQ ID NO: 340

SEQ ID NO: 344 - protein, 383 aa, Bacillus thuringiensis PS149B1
MLDTNKVYEISNHANGLYAATYLSLDDSGVSLMNKNDDDIDDYNLKWFLFPIDDDQYIITSYAANNCKVWNVNNDKINVSTYSSTNSIQKWQIKANGSSYVIQSDNGKVLTAGTGQALGLIRLTDESSNNPNQQWNLTSVQTIQLPQKPIIDTKLKDYPKYSPTGNIDNGTSPQLMGWTLVPCIMVNDPNIDKNTQIKTTPYYILKKYQYWQRAVGSNVALRPHEKKSYTYEWGTEIDQKTTIINTLGFQINIDSGMKFDIPEVGGGTDEIKTQLNEELKIEYSHETKIMEKYQEQSEIDNPTDQSMNSIGFLTITSLELYRYNGSEIRIMQIQTSDNDTYNVTSYPNHQQALLLLTNHSYEEVEEITNIPKSTLKKLKKYYF

SEQ ID NO: 345 - protein, 383 aa, Bacillus thuringiensis EG9444
MLDTNKVYEISNHANGLYAATYLSLDDSGVSLMNKNDDDIDDYNLKWFLFPIDDDQYIITSYAANNCKVWNVNNDKINVSTYSSTNSIQKWQIKANGSSYVIQSDNGKVLTAGTGQALGLIRLTDESSNNPNQQWNLTSVQTIQLPQKPIIDTKLKDYPKYSPTGNIDNGTSPQLMGWTLVPCIMVNDPNIDKNTQIKTTPYYILKKYQYWQRAVGSNVALRPHEKKSYTYEWGTEIDQKTTIINTLGFQINIDSGMKFDIPEVGGGTDEIKTQLNEELKIEYSRETKIMEKYQEQSEIDNPTDQPMNSIGFLTITSLELYRYNGSEIRIMQIQTSDNDTYNVTSYPDHQQALLLLTNHSYEEVEEITNIPKSTLKKLKKYYF

SEQ ID NO: 346 - protein, 383 aa, Bacillus thuringiensis PS167H2
MLDTNKIYEISNYANGLHAATYLSLDDSGVSLMNKNDDDIDDYNLRWFLFPIDDNQYIITSYAANNCKVWNVNNDKINVSTYSSTNSIQKWQIKANASSYVIQSNNGKVLTAGTGQSLGLIRLTDESPDNPNQQWNLTPVQTIQLPPKPTIDTKLKDYPKYSQTGNIDKGTPPQLMGWTLIPCIMVNDPNIDKNTQIKTTPYYILKKYQYWQQAVGSNVALRPHEKKSYAYEWGTEIDQKTTIINTLGFQINIDSGMKFDIPEVGGGTDEIKTQLNEELKIEYSRETKIMEKYQEQSEIDNPTDQSMNSIGFLTITSLELYRYNGSEISVMKIQTSDNDTYNVTSYPDHQQALLLLTNHSYEEVEEITNIPKISLKKLKKYYF

SEQ ID NO: 347 - protein, 387 aa, Bacillus thuringiensis EG4851
MIETNKIYEISNKANGLYATTYLSFDNSGVSLLNKNESDINDYNLKWFLFPIDNNQYIITSYGVNKNKVWTANGNKINVTTYSAENSAQQWQIRNSSSGYIIENNNGKILTAGTGQSLGLLYLTDEIPEDSNQQWNLTSIQTISLPSQPIIDTTLVDYPKYSTTGSINYNGTALQLMGWTLIPCIMVYDKTIASTHTQITTTPYYILKKYQRWVLATGSGLSVPAHVKSTFEYEWGTDTDQKTSVINTLGFQINTDTKLKATVPEVGGGTTDIRTQITEELKVEYSSENKEMRKYKQSFDVDNLNYDEALNAVGFIVETSFELYRMNGNVLITSIKTTNKDTYNTVTYPNHKEVLLLLTNHSYEEVTALTGISKERLQNLKNNWKKR

SEQ ID NO: 348 - protein, 387 aa, Bacillus thuringiensis PS201L3; identical to SEQ ID NO: 347

SEQ ID NO: 349 - protein, 387 aa, Bacillus thuringiensis PS201HH2; identical to SEQ ID NO: 347

SEQ ID NO: 350 - protein, 520 aa, Bacillus thuringiensis
MNVNHGMSCGCGCQQGKEEYNDYHVSNEYRDENPSTTCNSQQGNYEYEQSKETYNNDYQSYEYNQQNYNTCGRNQGTMEQESMQKDRNWENANYSGYDGCSPNQLNALNLPDESTRFQKITNVNTRDSHRVLDMMDVPSGTRLDTRVPPICSQTEFTNTVSNELVSTNHDTQFLIFYQTDDSSFIIGNRGNGRVLDVFPSNRNGYTIVSNVYSGSRNNQRFRMNKASNNQFSLQTIFKDRVNICGHIHNFNAIITATTLGENDSNALFQVQSSTNITLPTLPPRTTLEPPRALTNINDTGDSPAQAPRAVEGSVLIPAIAVNDVIPVAQRMQESPYYVLTYNTYWHRVISAILPGSGQTTRFDVNLPGPNQSTMVDVLDTAITADFRLQFVGSGRTNVFQQQIRNGLNILNSTTSHRLGDETRNWDFTNRGAQGRLAFFVKAHEFVLTRANGTRVSDPWVALDPNVTAAQTFGGVLLTLEKEKIVCASNSYNLSVWKTPMEIKNGKIYTKNEWNTKPNYK

SEQ ID NO: 351 - protein, 126 aa, Bacillus thuringiensis
MTVYNATFTINFYNEGEWGGPEPYGYIKAYLTNPDHDFEIWKQDDWGKSTPERSTYTQTIKISSDTGSPINQMCFYGDVKEYDVGNADDILAYPSQKVCSTPGVTVRLDGDEKGSYVTIKYSLTPA

SEQ ID NO: 352 - protein, 310 aa, Bacillus thuringiensis
MSILNLQDLSQKYMTAALNKINPKKVGTFHFEEPIVLSESSTPTRSEIDAPLNVMFHASQDLDNRRGTSDLKQTVSFSQTQINTVETKTTDGVKTTKEHTFSGTLELKIKYAMFDLGGVSGTYQYKKSTENDISSEKSKSKSDSQTWSISSEYTVKPGVKETLDFYIVGIKTEVPLNIFAEFQGTKTIDNVSNVMAYQEFISQDDEHIRACMKASKLANPDHLSGYTAPKELKANTSKGSVEFRGTAIAKINTGVKCLVVVNGKNSITGKTYSYIHPKTMLADGTIEYLESEIDLLESEIDLLTTSSILV

SEQ ID NO: 353 - protein, 660 aa, Bacillus thuringiensis aizawai
MNSYENKNEYEILNDSKKSNMSNPYLRYPLANDSLASMQNTNYKDWLTMCDRTDTDVLSSRGAVSTGVGMLSTILSLFGIPLIGEGIDLLLGAADFLWPESDGGHQYTWEDLMNHIEELMDERLETEKRTTALDDLRGLKALLGLFRDAFDSWEKNQNDPIAKNRVGGYFEDVHTHFVKDMASIFSATNYEVLLLPVYAQAANLHLLLLREGVIYGSRWGIAPAADFYHDQLLKYTAIYANHCVTWYNNGLAQQKELFAKSPNWNRFNAYRRDMTITVLDIIALFPTYDARLYTKPIKTELTREIYSDVLNLDVYGVQQTDLNKNEAAFTRSPHLVTRLRGFDFYTRTKYAYWRYLAGHTNYFSFTGNGTIYSSSFNNWYDTDMTKSTINIPDYANIYKLWTKSYTNISPYTDPVGISQMQFSLTNNQQLTYTGTSAPKYPVRETFFEIPPTDEKPLTYENYSHILSYMTSAQHFGDKKIGYTFAWMHESVDFDNRVDPDKITQIPAVKGDYLQYGYVKQGPGHTGGDLVSMIRTDRLGINVYFPQPLDYRIRIRYSTSSNGYLYIYSPNTKIVYLPPTTLVDGQPTFDPMDFSAFRVVEVPASFRASVAGYTNFTIEAGFGPVYIDKIEFIPDNTTTLEYEGGRDLEKTKNAVNDLFTN

SEQ ID NO: 354 - protein, 652 aa, Bacillus thuringiensis san diego
MIRKGGRKMNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 355 - protein, 652 aa, Bacillus thuringiensis 886
MIRKGGRKMNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANIHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFRPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPPEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKHRARIHYASTSQITFTLSLDGAPFNQYYFDKTINKGDTLTYNSFNLASFSTPFELSGNNLQIGVTGLSAGDKVYIDKIEFIPVN

SEQ ID NO: 356 - protein, 644 aa, Bacillus thuringiensis tenebrionis Mm2
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTSWPSEDPWKAFMEQVEALMDQKIADYAKNKALAELQGLQNNVEDYVSALSSWQKNPVSSRNPHSQGRIRELFSQAESYFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFNYLRRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 357 - protein, 644 aa, Bacillus thuringiensis tenebrionis
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 358 - protein, 644 aa, Bacillus thuringiensis tenebrionis; identical to SEQ ID NO: 357

SEQ ID NO: 359 - protein, 644 aa, Bacillus thuringiensis; identical to SEQ ID NO: 357

SEQ ID NO: 360 - protein, 644 aa, Bacillus thuringiensis tenebrionis
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENASAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 361 - protein, 644 aa, Bacillus thuringiensis morrisoni EG2158; identical to SEQ ID NO: 357

SEQ ID NO: 362 - protein, 644 aa, Bacillus thuringiensis tenebrionis; identical to SEQ ID NO: 357

SEQ ID NO: 363 - protein, 652 aa, Bacillus thuringiensis 22; identical to SEQ ID NO: 354

SEQ ID NO: 364 - protein, 652 aa, Bacillus thuringiensis YM-03
MIRKGGRKMNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTQFQPGYYGNDSFNYWSGNYVSTRPSIGSNDIITSPFYGNKSSEPVQNLEFNGEKVYRAVANTNLAVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 365 - protein, 644 aa, Bacillus thuringiensis UTD-001
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYKKEDIAEFLKRQLKLTQEYTDHFVQWYYVGLDKIRGSFYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSNDIITSPFYGNKSSEPVQNLGFNGEKVYRAVANTNLAVWPSAVNSGVTKVKFSQYNDQTDEASTQTSDSKRNVGAVSWDSIDQLPPEATDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 366 - protein, 659 aa, Bacillus thuringiensis tolworthi 43F
MIRMGGRKMNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 367 - protein, 651 aa, Bacillus thuringiensis PGSI208
MNPNNRSEYDTIKVTPNSELPTNHNQYPLADNPNSTLEELNYKEFLRMTADNSTEVLDSSTVKDAVGTGISVVGQILGVVGVPFAGALTSFYQSFLNAIWPSDADPWKAFMAQVEVLIDKKIEEYAKSKALAELQGLQNNFEDYVNALDSWKKAPVNLRSRRSQDRIRELFSQAESHFRNSMPSFAVSKFEVLFLPTYAQAANTHLLLLKDAQVFGEEWGYSSEDIAEFYQRQLKLTQQYTDHCVNWYNVGLNSLRGSTYDAWVKFNRFRREMTLTVLDLIVLFPFYDVRLYSKGVKTELTRDIFTDPIFTLNALQEYGPTFSSIENSIRKPHLFDYLRGIEFHTRLRPGYSGKDSFNYWSGNYVETRPSIGSNDTITSPFYGDKSIEPIQKLSFDGQKVYRTIANTDIAAFPDGKIYFGVTKVDFSQYDDQKNETSTQTYDSKRYNGYLGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNIDGDLTYQTFDFATSNSNMGFSGDTNDFIIGAESFVSNEKIYIDKIEFIPVQ

SEQ ID NO: 368 - protein, 652 aa, Bacillus thuringiensis EG4961
MNPNNRSEHDTIKVTPNSELQTNHNQYPLADNPNSTLEELNYKEFLRMTEDSSTEVLDNSTVKDAVGTGISVVGQILGVVGVPFAGALTSFYQSFLNTIWPSDADPWKAFMAQVEVLIDKKIEEYAKSKALAELQGLQNNFEDYVNALNSWKKTPLSLRSKRSQDRIRELFSQAESHFRNSMPSFAVSKFEVLFLPTYAQAANTHLLLLKDAQVFGEEWGYSSEDVAEFYHRQLKLTQQYTDHCVNWYNVGLNGLRGSTYDAWVKFNRFRREMTLTVLDLIVLFPFYDIRLYSKGVKTELTRDIFTDPIFSLNTLQEYGPTFLSIENSIRKPHLFDYLQGIEFHTRLQPGYFGKDSFNYWSGNYVETRPSIGSSKTITSPFYGDKSTEPVQKLSFDGQKVYRTIANTDVAAWPNGKVYLGVTKVDFSQYDDQKNETSTQTYDSKRNNGHVSAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFLVIYINKTMNKDDDLTYQTFDLATTNSNMGFSGDKNELIIGAESFVSNEKIYIDKIEFIPVQL

SEQ ID NO: 369 - protein, 652 aa, Bacillus thuringiensis EG5144
MNPNNRSEHDTIKVTPNSELPTNHNQYPLADNPNSTLEELNYKEFLRMTEDSSTEVLDNSTVKDAVGTGISVVGQILGVVGVPFAGALTSFYQSFLDTIWPSDADPWKAFMAQVEVLIDKKIEEYAKSKALAELQGLQNNFEDYVNALNSWKKTPLSLRSKRSQDRIRELFSQAESHFRNSMPSFAVSKFEVLFLPTYAQAANTHLLLLKDAQVFGEEWGYSSEDVAEFYHRQLKLTQQYTDHCVNWYNVGLNGLRGSTYDAWVKFNRFRREMTLTVLDLIVLFPFYDVRLYSKGVKTELTRDIFTDPIFSLNTLQEYGPTFLSIENSIRKPHLFDYLQGIEFHTRLQPGYSGKDSFNYWSGNYVETRPSIGSSKTITSPFYGDKSTEPVQKLSFDGQKVYRTIANTDVAAWPNGKIYFGVTKVDFSQYDDQKNETSTQTYDSKRNNGHVGAQDSIDQLPPETTDEPLEKAYSHQLNYAECFLMQDRRGTIPFFTWTHRSVDFFNTIDAEKITQLPVVKAYALSSGASIIEGPGFTGGNLLFLKESSNSIAKFKVTLNSAALLQRYRVRIRYASTTNLRLFVQNSNNDFIVIYINKTMNIDDDLTYQTFDLATTNSNMGFSGDTNELIIGAESFVSNEKIYIDKIEFIPVQL

SEQ ID NO: 370 - protein, 649 aa, Bacillus thuringiensis kurstaki BtI109P
MNPNNRSEHDTIKATENNEVSNNHAQYPLADTPTLEELNYKEFLRRTTDNNVEALDSSTTKDAIQKGISIIGDLLGVVGFPYGGALVSFYTNLLNTIWPGEDPLKAFMQQVEALIDQKIADYAKDKATAELQGLKNVFKDYVSALDSWDKTPLTLRDGRSQGRIRELFSQAESHFRRSMPSFAVSGYEVLFLPTYAQAANTHLLLLKDAQIYGTDWGYSTDDLNEFHTKQKDLTIEYTNHCAKWYKAGLDKLRGSTYEEWVKFNRYRREMTLTVLDLITLFPLYDVRTYTKGVKTELTRDVLTDPIVAVNNMNGYGTTFSNIENYIRKPHLFDYLHAIQFHSRLQPGYFGTDSFNYWSGNYVSTRSSIGSDEIIRSPFYGNKSTLDVQNLEFNGEKVFRAVANGNLAVWPVGTGGTKIHSGVTKVQFSQYNDRKDEVRTQTYDSKRNVGGIVFDSIDQLPPITTDESLEKAYSHQLNYVRCFLLQGGRGIIPVFTWTHKSVDFYNTLDSEKITQIPFVKAFILVNSTSVVAGPGFTGGDIIKCTNGSGLTLYVTPAPDLTYSKTYKIRIRYASTSQVRFGIDLGSYTHSISYFDKTMDKGNTLTYNSFNLSSVSRPIEISGGNKIGVSVGGIGSGDEVYIDKIEFIPMD

SEQ ID NO: 371 - protein, 666 aa, Bacillus thuringiensis aizawai
NSYENKNEYEILESSSNNTNMPNRYPFANDRDMSTMSFNDCQGISWDEIWESAETITSIGIDLIEFLMEPSLGGINTLFSIIGKLIPTNHQSVSALSICDLLSIIRKEVADSVLSDAICRFLDGKLKNYREYYLPYLEAWLKDGKPLQKTNNSDIGQLVKYFELSERDFNEILGGSLARNNAQILLLPYFCASCKCQLLLLRDAVQYEEQWFPFLSAENVRSELISPNSGCDFTGDYYERLKCKIAEYTDYCEYWYQAGLNQIKQAGTGADTWAKFNKFRREMTLTVLDIIAIFQTYDFKKYPLPTHVELTREIYTDPVGYSSGTYSWLKYWTGAFNTLEANGTRGPGLVTWLRSIGIYNEYVSRYFSGWVGTRHYEDYTTGNGNFQRMSGTTSNDLRDISFPNSDIFKIESKAIMNLVGEINARPEYRVSRAEFSESTAFIYLYDAGNSGLSSMTITSKLPGIKNPEPSYRDYSHRLSNAACVGAGNSRINVYGWTHTSMSKYNLIYPDKITQIPAVKAFDISDTGPGQVIAGPGHTGGNVVSLPYYSRLKIRLIPASTNKNYLVRVRYTSTSNGRLLVERWSPSSIINSYFFLPSTGPGDSFGYVDTLVTTFNQPGVEIIIQNLDTPINVDKVEFIPVNSTALEYEGKQSLEKAQDVVNDLFVK

SEQ ID NO: 372 - protein, 666 aa, Bacillus thuringiensis serovar aizawai
MNSYQNKNEYEILKSSPNNTNIPNRYPFANDRDMSPMSWNDCQGSPWNDVWESTASFTGIGIDLITFLGEPSITGINLLFSVIGKLLPSGQNVASLSICDLLSIIRKEVDESVLSDAYGDFNGVVNNYQTYYLTSLKKWLDAGKPTTGQLLTDVTKHFEFSEREFNALLKGSLSRPKGEILLLPTYTQGANLHLLLLRDFVQYKAVWEKELRTENVESELISPSFDYEGHFKEQLAEHINHCITWYQAGLNQIKESGTSTENWLKFNKFRREMTLSVLDIIAIFPTYDFENYKSETHIELSREVYTDPVGYNGWEQNLTNGFNTLEANGTRGPGLVTWLKKIDIFTDEVTEYSGWSPVAILRGWAGTRHYEIYTGSSNTLQRISGTTSNDVSNIDFINSRIFIITSLARYALAGAAAGNPGSPRYRVSRVEFRSTGRYTFLYEVNSPGISSMTIESKLPGVKNATGFTDYFNRLSNAACVQFGTSRVNVYGWTHISMGEGNYVYPNKITQIPAVKAWEIRGTSSVVAGPGHTGGNLVKMSYHSVWSIKFTCQQLKRYRVRIRYASDGNCQLAMRRWRGGPGYVQEARHTVQRTFSGSMTYDSFKYLDIFTMPAEDYTFDLTIDLESGGALYIDKIEFIPDDLTTLEYEEERNLEKTKNAVNDLFTN

SEQ ID NO: 373 - protein, 657 aa, Bacillus thuringiensis Y41
MNSYENKNEYEILESSSNNTNMPNRYPFANDRDISPMSWNDCQGSSWEDVWESTSSLASIGIDLIDHMFIAGPSITSINLLFSIIGKLIPSSGQSISSLSICDLLSIIRKEVDESVLSGAYGDFNGVLANYRDYYLKSLKTWLDEGQPTTGQSLKDVTKHFEASEREFNALLQGSLSRPKGEILLLPTYAQGANFHLLLLRDFVQYKDAWANELRTENVESELISPTFDYEGRFKEQLAKHINHCIYWYQAGLDQIKQGGTGADIWTKFNKFRREMTLSVLDIIAIFPTYDFEKYPLPTHVELTREIYTDAVGYSSGTYSWLRNWPNTFNALEANGTRGPGLVTWLSKIGIYNEYVSRYFAGWVGTRHYEDYTKGNGIFQRMSGTTSNDLRNIDFQNADVYKITSLAIMNLVGETTARPEYRVSKADFRRVGGPDLNYDAGNNGLSRMTIESTFPLVLDSNGVRGPSHRLSNAACVVYGNSRVNVFGWTHTSMTKNNPIYTDKISQIPAVKAFEISNYATVYAGPGHTGGGVVGLTISYQLKIRLAPASTNKNYRVRVRYASTSNGRIRVERWSPSSVINNDFPYSSTGSRDIFGYVDTLVTTFYQSGVEIIIQNIAFGEIIIDKVELIPLDSTTLEYDGEQNLKKAQNVVNDLFTN

SEQ ID NO: 374 - protein, 658 aa, Bacillus thuringiensis S2096-2
MNSYQNTNGYEILESSSNNTNTPNRYPFANDPNIFPIILNDCPGKPWQDTWKSISNFISVMVSMAGFISSPGVLIGIPALLGIVNLLIPSSGPSVAALSICDLLSIIRKEVDESVLNDAVADFNGKLTNYKEYYLSSLQEWLSAGKPNDSRLSNVVEYFKKSEEGFNEILAGSLSRQNAQILLLPTFAQAANVQLLLLRDAVQYKKEWGALLSAEKVGSELISPTIDYGQRLKDKIAQYAKYCVFWYQEGLNQIKEEGAGTTTWLKFNKFRREMTLAVLDIIALFPIYDFEKYPLGTNVELTREIYTDPVGYSRGNYRWEGLFSFNSLEANGTRGPGLVTWLQAIDIYSHPVFTQPGYLIGWGGTRHYEDYTKGNGAFQRMSGTTSNDPHSISFGNTDIFKISSLARVELQPFVGYSIPRYRTSRAEFFPTTLNTLLYERNSSGYSQTIESVLPGIDKDLPPSARNYSHRLSNAACVQYETSVVNVFGWTHTSMTRNNPIYPDKITQIPAVKAFALENGAYVSAGPGDTGGDVVTLPYLGRLKIRLTPAPTNKNYRVRIRYATSYGASLMVQRWSPSGSESDYFGSSPTGPYPTFGYMNTLVTTFNQSGVEIIIENRHYSNIIIDKIEFLPDDLTTLESEGERNLEKTKKAVNDLFIN

SEQ ID NO: 375 - protein, 825 aa, Bacillus thuringiensis A1462
MNQNCNNNGYEVLNSGKGYCQPRYPFAQAPGSELQNMGYKEWMNMCTSGDPTVLGEGYSADVRDAVITSINIASYLLSVPFPPAGVAAGILGALLGLLWPTNTQAVWEAFMNTVEALINQKLDEYARSKAISELNGLKNVLELYQDAADDWNENPGDLRNKNRVLTEFRNVNGHFENSMPSFAVRNFEVNLLPVYAEAANLHLLLLRDAVKFGEGWGMSTDPGAERDDMYRRLRSRTEIYTDHCVNTYNQGLQQAKSLQANVSDYSRYPWTQYNQSGGFSYREAKGEYRGTENWNLYNAFRRDMTILVLDIIAQFPTYDPGLYSRPVKSELTREVYTDIRGTTWRSDANLNTIDAIENRMVGSRQLQLFTWLTEMKFYIRNTGSITSYTHGDLMVGLEKKIRKTNDNDQWLPLEGQNTSYTRIDRPGIELGKNYWYYARTQQWFETRLLQLWANTDVLSLNAGTVGNEFWVRDVPDYRNIYARSTRNHFIENHRLSWIKFEPVRDNCPFAWPGYKQLSALLFGWTHNSVDLNNIISQYRITQIPAVKAYWNRGAFSVIRGPGSTGGNLVQLGTGGEVSVKVRPEQTGSDWYRVRIRYAAGSRGRLNVKKYVSSIHASVTYDYNMTMSSSTQGTYNSFQYLDVYNFRLAEPEFEVWLTNESGGPIWIDKIEFIPLSPIPELPVYPGTYQIVTALNNSSVVTSEEFCMGIGLTTRCGVNLWSNNGNTLQKWRFVYNGDQNAFQIKSTPNEDLVLSGSNSGTSVTAETNQNRPNQYWLIEEAGNGYVYLRSKGNPNLVLDVAGTSTANGTNIILWNYNGSTNQKFKLS

SEQ ID NO: 376 - protein, 829 aa, Bacillus thuringiensis A1462
MNQSCNNNGYEVLNSGKGYCQPRYPFAQAPGSELQNMGYKEWMNMCTSGDPTVLGGGYSADVKDAVITSINIASYLLSVPFPPAGVAAGILGALLGLLWPTNTQAVWEAFMNTVEALINQKLDEYARSKAISELNGLKNVLELYQDAADDWNENPGDLRNKNRVLTEFRNVNGHFENSMPSFAVRNFEVNLLPVYAEAANLHLLLLRDAVKFGEGWGMSTDPGAERDDMYRRLRSRTEIYTDHCVNTYNQGLQQAKSLQANVSDYSRYPWTQYNQSGGFSYREAKGEYRGTENWNLYNAFRRDMTILVLDIIAQFPTYDPGLYSRPVKSELTREVYTDIRGTTWRSDANLNTIDAIENRMVGSRQLQLFTWLTEMKFYIRNTGSITSYTHGDLMVGLEKKIRKTNDNDQWLPLEGQNTSYTRIDRPGIELGKNYWYYARTQQWFETRLLQLWVNTDVLSLNAGTVGNEFWARDVPDYRNIYARSTRNHFIENHRLSWIKFEPVRDNCPFAWPGYKQLSALLFGWTHNSVDPFNTIASDRITQIPAVKGYLVDNGATVVRGPGNTGGDLVRLPAYNQQWTQLRVKVRPSTTARTRGYNVRIRYASEGNANLFVGKYVDTANRFYETGNYAVNQTFSGSMTYNSFKYLDAIGFAANEEEFRIELRCNSGGPIYIDKIEFIPVNPIPEPPEGIYQIVTALNNSSVVTSEEFCMGIGLTTRCGVNLWSNNGNTLQKWRFVYNGDQNAFQIKSTPNEDLVLSGSNSGTSVTAETNQNRPNQHWLIEEAGNGYVYLRSKGNPNLVLDVAGTSTANGTNIILWNYNGSTNQKFKLS

SEQ ID NO: 377 - protein, 864 aa, Bacillus thuringiensis serovar andalousiensis BGSC 4AW1
MPLFVVYKSEHTCYSTCEVKKGGLYMNPYFKNNAYEILDDGNMNYHPKYPLTQPLGSELQNIHYKDWLATFPERNDSILGENSSLRDGIITSTNIIAYLLSVPFPAAGAAAGILGALLGFLWPTNTQAVWEAFMEAVEALIDQKISDFAREQAIARLEGINKAIELYQNALSNLEKNPNNAVLREHVREQFIATNTYIVGSMPLFRVKGYEVPMLTMFTEAANLHLLILRDAAKFGASWDMDVSTIESYQQYLEKETVNYTDYCVGTYNVGLEEAKTLFADLCDLNTYPWTRYNQGWREEEKPNCSLQQINRYEQQLNEQINSYRAAFRYSPGEYQKLENWNLYNAFRRNMTIMVLDLVSLWPTYNPKQYVLPVKAELTREIYTDIRGTTYQSDESQNTLPVIEGRMIPPPRLFQWLRSFTFHLQNVHSDWTAGQIATGLQQTVQTTLGPSQVLPLTGVQGTSTTSFIPYIDGITRIDTQQWFEPRRFKFWSGGYIEKNFGSIEEKSPFWAEGPKWRVYEPSARANEILEHRLSWMTYEPVRSNAPFVYPQYKQLGALALGWTHQSVDPENRVVSDKITQIPAVKAYWNRGAFSVVKGSGSTGGDLVQLSPSGEVSIMVKPSRSGIGQFRVRIRYAATANGRLNIKKYVGSIHASQSYDYKQTTTSNLTFSAFQYLDVYNFNLAETQFEVWLTNESGGPIFIDKIEFIPTTPTPEPEPQNPPVPEGRYQMVTALNNSSIVDLNLSQRYVQIYGNGNAENQKWRFVYDASKDAYQIINVAAGQELVLSWFQYPEEPDAVIGEPNNKLNRQYWIFEDAGNGYTYVRNMADLNRVLDVPNGNTGNGTPIYASYFSGGTNQKFKLNKL

SEQ ID NO: 378 - protein, 810 aa, Bacillus thuringiensis A1462
MNQNYNNNGLEILDSGGVCSPRYPLANAPGSELQNMGYKEWLEMCSIKGAETFADKSTLSAQSQEGLRTAITIALSLLSNLPGPFGYPAKLLSIIFPFLWPTNTQAQWEAFMKVVEELVDQKIETFARDQAIQRLRGIQDVISLYQRDAKNFNDYPTSEPIQRQLLSQFTATNTFIVGSMSLFRVGRHEVPLLTTFVQAANLHLLLLRDAIMFGESWGMCPVTVAGYQNDFNNRIADYTDYSVSIYNQGLQKAKTLKANLRDYEKYPWARYYNSSVGPEFAYGDMENWNLYNNYRRDMTLMVLDLVALWPTYNPQQYPIAPKIQLTREIYTELRGNAGNTKRPSMDAIDAELIPPPRLFTWLESVDMHRWPTSAGYYYYTFQNAGIKHRYKYTLDSQTLTSSLRGASGNNFNLVPAEETINRVQNQHGEGLYTFSFYRSGQSDPFLNIGTTADKPYVSTMNRIPVEGDQTQANHRLSWITGMVIPELSIPAFGHYNPTYISCAAEGWTHLSVERSNEIKSDKITQIPAVKAFQLSNNASVVRGPGSTGGDLVQFSATSSGNKQLWIKVKPTTIALGRRFKVRIRYAAAANVTFTVQKCVTGVACWETATKSVTTTYSGTLTYNAFKYVDIFEIPANESEFSLEFLSTSGGPIYIDKIEFIPVNPIPEPPVPEGIYQIVTALNNSSVVDMDPGTWGTRHNVHLWQNNNTNNQKWRFVYNSSQGAYQIRNLADENLVLTREGANVKVVSYQNNNTAQYWIIEDAGNEYVYLKSKADPSRVLDVTGSSTQNGTNIQVWSNYGTLNQKFKLVKL

SEQ ID NO: 379 - protein, 1344 aa, Paenibacillus lentimorbus semadara
MNQYHNQNDNKSYNQSGNEMQIIQPSSNSLLYSPNKYPYATDPNVIAEGRSYKNWLDMCVGEGDGTRSLEAIAVAVGVRISHTIFRLLGVPYSAQGEQLFSFLLDTLWLEGNTQWEELMRHAEELINEQVPDYVRTKALAELTDLGNNLNLYIAAFEDWKRNPSSQEVRTRVIDRFNILDGLFEAYLPSFAVPGYEVPLLSVYANVVNIHLLVLRDSSIYGLDWGLSSTSVDNNYNRQQRNSATYANHCTTWYQTGLQRLQGSDASSWVNYNRFRREITLIVLDICALFSNYDVRSYPIQLRGELTRGIYTDPAVYSGTGSYSWLSQAPSFAEIENIAIREPSNFTWASYARVTTGTLEYLSSKNDFWKSHYMNYTETNSGILIQGPTYGMTTGTNIRIESVSMQEIYSVRLEAVAHAGAGGPFLGISTSEFFWSLGVRRYQNSRSPQFASQIITRQLPGVNSAVPSALDHSHELSYITAFPVRSVGTILVHEWTSTTVSRNNRIEPDKITQIPAVKSHTLSNCQVVSGTGFTGGNWLRPSDNGSFRLTITSFSSQSYRIRIHYASATFFYLDIRTGDTSNTFAVTPTTLSSGSQTVPYESFGFINIPYTFTTAPTESRYTFDFMFYSIGSANVLIDRIEIVPIGVPLFEYETKQQLEKARKAVNHLFTDGSKKALKEDTTDYEIDQAANVVDCISDECGHDKMILLDEVKYAKQLSQARNLLLNGNFDDLYSALEKENPWKTSPNVTIRQDNPIFKGHYLSMAGANDIEATNDTFPTYVYQKIDEAKLKPYTRYKVRGFVGSSKALELLVTRYNEEVDAILDVPDNIPHAPTPVCGEFDRCKPYSYPPLLPECNPEFINQMQPSSCHHNQMVDYNNMNTSTSTTMNPSMNPPLTPEIASSQSGFGRKHRKCHQAHQFEFHIDTGTIDLVEDLGIWVIFKICATDGYASLDDLEVIEEGALGVEALELVKKREKKWRHQKEQHCSQTKHKYDAAKHAVMALFTNKRYEKLKFETTISDILYADHLVQSIPYVYNKYVPEVPGMNYELYSELNTLVQNAFYLYDQRNLIKNGRFSNGLMHWQATPHARVEQEYEKSVLVLPNWDANVSQDLCIEHNRGYVLRVTARKEDPGAGNVTFSDCENHVDKLSFTSCDIATNAVPGAQANDPAAGVAYGQQGCQIDRVPYGQSGYRADGVAYEQSGHRTDGVPYRQSGYGTDGVTYEQSGHRADGVPYGQSGYRADGVAYEQSGHRADGVPYGQSGYGTDGVTYDQSANQTRKYHGCHTDGLPHPEHGCCYPDRVSDGQQLAYVTKSIDLFPDTDKVRIDIGETEGNFRVESVELICMEK

SEQ ID NO: 380 - protein, 1340 aa, Paenibacillus popilliae popilliae
MNQYQHQNDNKSYNQHGNEMQIIQPSSNSLLYSPNKYPYATDPNVIAEGRSYNNWLDTCVGVGDGTRSPETDAVAVGVRISHTIFRLLGVPYSAQGEQLFSFLLDTLWLEGNTQWEELMRHAEELINEQIPDYVRTKALAELTDLGNNLNLYIAAFEDWKRNPSSQEVRTRVIDRFNILDGLFEAYLPSFAVPGYEVPLLSVYANVANIHLLVLRDSSIHGLDWGLSSTSVDNNYNRQQRNSATYAIHCTTWYQTGLQRLQGSDASSWVNYNRFRREITLIVLDICALFSNYDVRSYPIQLRGELTRGIYTDPAVFSGTGSYSWLSQAPSFAEIENIAIREPSNFTWANYARVTTGTLEYLSSKNDFWKSHYMNYTETNSGILIQGPTYGMTTGTNIRIESVSMQEIYSVRLEAVAHAGAGGPFLGISTSEFFWSLGVRRYQNSRSPQFASQIITRQLPGVNSAVPSALDHSHELSYITAFPARSVGTILVHEWTSTTVSRNNRIEPDKITQIPAVKSHTLSNCQVVSGTGFTGGNWLRPSDNGSFRLTITSFSSQSYRIRIRYASATFFYLDIRTGDTSNTFAVTPTTLSSGSQTVPYESFGFINIPYTFTTAPTESRYTFDFMFYSIGSANVLIDRIEFVPIEGSLFEYETKQQLEKARKAVNHLFTDGSKKALKEDTTDYEIDQAANVVDCISDECGHEKMILLDEVKYAKQLSQARNLLLNGNFDDLYPALERENPWKTSPNVTIRRDNPIFKGHYLSMAGANDIEATNDTFPTYVYQKIDEAKLKPYTRYKVRGFVGSSKALELLVTRYNEEVDAILDVPDNIPHAPIPVCGEFDRCKPYSYPPLLPECNPEFINQMQPSSCHHTQMVDYNNMNMSTSTTMNPTLTPEIASSQSGFGRKHRKCHQAHQFEFHIDTGTIDLVEDLGLWVIFKICATDGYASLDDLEVIEEGALGVEALELVKKREKKWRHQKEQHCSQTKHKYDAAKHAVMALFTNTRYEKLKFETTISNILYADHLVQSIPYVYNKYVPEVPGMNYELYSELNTLVQNAFYLYDQRNLIKNGRFSNGLMYWQAAPHARVEQEFEKSVLVLPNWDANVSQDLCIEHNRGYVLRVTARKEDPGAGNVTFSDCENHVDKLSFTSCDIATNAVPGAQANDPAAGVAYGQQGCQIDRVPYGQSGYRADGVAYEQSGHRTDGVPYRQSGYGTDGVTYEQSGHRADGMPYGQSGYRADGVAYEQSGHRADGVPYGQSGYGTDGVTYDQSANQTRKYHGCHTDGLPHPEHGCCYPDRVSDGQQLAYVTKSIDLFPDTDKVRIDIGETEGNFRVESVELICMEK

SEQ ID NO: 381 - protein, 1332 aa, Paenibacillus lentimorbus semadara
MQIIQPSSNALLYSPNKYPYATDPNVIAEGRSYNNWLDTCVGVGDGTRSPEAYAIAEEAVGLSIDILAEIIYYLGFPIASPLTRALSAIAGQLFSSGDTLMQHIEQLINQKIAEYARNKALAEFQGLGRQYGLYLEALEDWEQNRLSQPHKERVRQTFRILDNSFTSSIPSFAVRNYEVPLLSVYADAANLHLLILRDSYIYGAFWGFDEDEYYRNYARQIRLSAEYANHCTTWYQTGLRRLQGTRATDWINYNRFRREMTLTVLDICALFSSYDIPSYPMGTKIQLTREIYTDPVVHSDWLQSTSPGLISFSSLENLVVRAPHLFTWLSRVTIDTGILSTVIGGQYSNNNFWRTHYQTLRTTGGTSFQSPTYGSTAFPIQRTNTLTFSGDVYTIESSVVTRSSLYGANSVAFTGTTGRSLYENPTVYPFAQKLIHELPGVDSGRPNATNYSHRLSYISGFSLGYSPSGTGLVYGWTSTTATRENNITLDDRIVQLPAVKGASLNNCQVVKGTGFTGGDWLKPNNNGTFSMYFAFRSAYTYHFRIRYASSASFSFVISEEYGRFPTTTVPLLSTMSPLPQNTPFEAFKTVDLPSTVTIRYTSAASTTFQLNFRFTVPGSANVLIDRIEFVPIEGSLFEYETKQQLEKARKAVNHLFTDGSKKALKEDTTDYEIDQAANVVDCISDECGHEKMILLDEVKYAKQLSQARNLLLNGNFDDLYPALERENPWKTSPNVTIRQDNPIFKGHYLSMAGANDIEATNDTFPTYVYQKIDEAKLKPYTRYKVRGFVGSSKDLELLVTRYNEEVDAILDVPDNIPHAPTPVCGEFDRCKPYSYPPLLPECNPEFINQMQPSSCHHNQMVDYNNMNTSTSTTMNPSMNPPLTPEIASSQSGFGRKHRKCHQAHQFEFHIDTGTIDLVEDLGIWVIFKICATDGYASLDDLEVIEEGALGVEALELVKKREKKWRHQKEQHCSQTKHKYDAAKHAVMALFTNTRYEKLKFETTISDILYADHLVQSIPYVYNKYVPEVSGMNYELYTELNTLVQNAFYLYDQRNLIKNGRFSNGLMYWQATPHARVEQEYDRSVLVLPNWDANVSQQLCIEHNRGYVLRVTARKEDPGAGNVTFSDCANHVDKLSFTSCDIATNAVPGAQANDPAAGVAYGQQGCQIDRVPYGPSGYRADGVAYEQSGHRTDGVPYRQSGYRADGVAHDQPGYRADGVAYEQSGYRADGVAYEQSGHRADGVPYGQSGYGTDGVTYDQSAKQTRKYHGCHTDGLPHPEHGCCYPDRVSDGQQLAYVTKSIDLFPDTDKVRIDIGETEGNFRVESVELICMEK

SEQ ID NO: 382 - protein, 405 aa, Paenibacillus lentimorbus semadara
MNQYHNQNDNKSYNQSGNEMQIIQPSSNALLYSPNKYPYATDPNVIAEGRSYKNWLDMCTGTGDTRSPEAAAISKGAVSAAITISTGLLGLLGVPFASQIGAFYTFLLNTLWPASNTQWEQFIAHVEELINAKLTDHVRNSALTKLNGLRNNIEIYNEALIVWKQDPNNSKLKDDVRSKFVGLNSQFEEYIPQFKEEGFEVQLLTIYAQSANLHLLLLRDSSLYGASWGFAQATIDNNYNRQIRKTAEYANHCTTWYQTGLQRLQGTTASSWLSYHRFRREMTLTVLDICALFSNYDARSYPLEVRGELTREIYTDPVAPGTNWIDRAPSFAEIENLVIRAPRTVTWISGDLIVYTGRLYGYTGNNDYWAAHRLDFLETNGYRFEGPTYGSTINISRTDSIPMNS

SEQ ID NO: 383 - protein, 686 aa, Bacillus thuringiensis entomocidus INA288
MNSYQNKNEYEILNAPSNNTNMPNRYPFANDPNAMMKNGNYKDWLDICNPEYRYSNPEAYRNTKAAMSFGVGLVSTILGVLGGPISVTLGAIIGVVTAVLEFIPADEYDNTKETWGVLIAAIKELIYEEIKGEAMNAAKAKLDGLYKVMKNYDNKLNVWKNGDKSPVEQNEIQRVFADTNNSFLLLISQFQQLGHEVSFLPLFAVAANFHLLLLRDVSIYGKEWGYTNNIIEGYHSDQLDMTQDYTNYAVDTYNKGLEEAKKIKNSDKLDWDFYNQYRRDMTLTVLDVIALFPTYDVRKYPISTKVELTREIYTDMINYINNPFMTNPVEGQRFAGYTVAQFNSIENALTREPHLFTWLKEVTGYFYAQYGQQSFMTGIQNTSYRTNYEDYPFSGPLHGVRYAGDTARSVDNNGKDVYSIYSTMFPLETNNHVHELRPGTAYYFGVKGHRHDATDRRTGNSSQKILGEDSKTGRIATGPSYFISEIPYYDKETNETIRPTPEKYNHRLSYISAYATDCGRISGVRGDGCFRTPQMCAWTHVSADPYNTIHPDKITQISAVKAFYIWDTGEGQVVSGPGFTGGDLVKLPYNARLKIRLKPTSTSKKYRVRVRYASMGAGTLRAEKWSPYGSVFSNFAYEYTGDSNKFNNFKYLETLSESFNISGVEIIIQNLSSSQLIVDKLEFIPI

SEQ ID NO: 384 - protein, 275 aa, Bacillus thuringiensis 89-T-34-22
MAIINLANELAIWAKRWCAARGYTYLVSGLQAHTGNYGRIYNYNMSVPDPIVTDNPTNAAMARGTTPNPTSQPIIRTISFNETLTDSQSTATEHGITAGAEVTVKSEAGLIFAKVGFEVKVSFQYNYTTTNTYTTETSRSWTDSLQITVPPGYVTEHTFIVQTGPYSKNVVLEADIAGHGWFNYSAPGYTGTGIVNITQVLYDNKVPGVTPYPDNFYARFRGSGKLEGKMGLQSFVNLVERPLLGRAGQVREYQIPVSLPSGLDIPIFDPVVSLQ

SEQ ID NO: 385 - protein, 338 aa, Bacillus thuringiensis dakota
MYNDKRMCSDPYQGMNKPHYCNCHTYNNSEITGGLQVDLDNQVVETFQSTTDVIREYLMFNELSALSSSPESVRSRFSSIYGTNPDGIALNNETYFNAVKPPITAQYGYYCYKNVGTVQYVNRPTDINPNVILAQDTLTNNTNEPFTTTITITGSFTNTSTVTSSTTTGFKFTSKLSIKKVFEIGGEVSFSTTIGTSETTTETITVSKSVTVTVPAQSRRTIQLTAKIAKESADFSAPITVDGYFGANFPKRVGPGGHYFWFNPARDVLNTTSGTLRGTVTNVSSFDFQTIVQPARSLLDEQQETLEYAIPGDPSGEQLQQMEQRMFFSKCQCPKWGN

SEQ ID NO: 386 - protein, 338 aa, Bacillus thuringiensis A1470
MYNDKRMCSDPYQGMNKPHYCNCHTYNNSEITGGLQVDLDNQVAETFQSTTDVIREYLMFNELSALSSSPESVRSRFFSIYGTNPDGIALNNETYFNAVKPPITAQYGYYCYKNVGTVQYVNRPTDINPNVILAQDTLTNNTNEPFTTTITITGSFTNTSTVTSSTTTGFKFTSKLSIKKVFEIGGEVSFSTTIGTSETTTETITVSKSVTVTVPAQSRRTIQLTAKIAKESADFSAPITVDGYFGANFPKRVGPGGHYYWFNPARDVLNTTSGTLRGTVTNVSSFDFQTIVQPARSLLDEQQETLEYAIPGDPSGEQLQQMEQRMFFSQCQCPKWGN

SEQ ID NO: 387 - protein, 304 aa, Bacillus thuringiensis
MYYTTQVTGGFQADLNNQVVETFQPSTNVIQEYLTFNDLPALGSSPQSVRSRFSSIYGTNPDGIALNNETYFSAVQPPITVQYGHYCYKNVGTVQYVNRPTDINPNVILAQDTLTNNTNEPFTTTITLTGSWTKSSTVTSSTTTGLKITTKLSIKKVFEIGGEVSFSTTIGSSEATSETFTVSKAVTVTVPAQSRRNIQLTAKIARESADFSAPITVDGYFGANFPRRVGPGGHYFWFNPARDVLNATSGTLRGTVTNVSSFDFQTVVQPAYSLLAEQQEALESAISGDPSEEQLKQIQQTIGL

SEQ ID NO: 388 - protein, 1134 aa, Bacillus thuringiensis CAA890
MNSNDSQNHDKLEICSNASLLSTPPYKTEYYEGEVLMDTIPFSSGKSAAQMGTSIVGQILGVLGVPFALQVTNLYSSLLDTLWPDGKSQWEIFMEQVEEIVDQKIENYARNKALAELEGLGNNFEVYLEALENWQSNTRDINDVKIRFISLDSLFTQSMPSFRIEGFQLPLLSVYAQAANLHLLLLRDATTFGKEWGLDSATMDSYYKRQKALSAEYSDHCVKWYKNGLNKLSKSTAKDWVKFNQFRREMTLTVLDVVALFPNYDAKIYPMQTVTQLTREVYTDPVGMTNLPNGIGSWYDIAPTFATIENAVIRKPHLFDFIRNLYVYFGDRGASANRSMKFWNGHEIFYANIGSSVFFQVYNYVKLGSNNYPYVFVDRDIYQTESLAGCIYDIIYPGYTYKFFGAPKVEFHVVDRRNNTGIFTFNPGFGQIIQNVQNSLSQLPLESLDEPAYEAYSHRLCHVTLVPPGNNSNYEGLPVYSWTHKSASLENVIYPDKITQIPAVKSFPGGQWGGVEAGPGFTGGDVTKSVTSEATTILRDVVKLAVTIPQDSIKQKYRVRIRYASQTDIPATFFTSDSGNRDFVLKSTTTAASNAFENYKEFQYIDIPGTIEFTKVNEIVTVYLHAYKVSNHHVNIDKVEFIPVDNNFEARKQLETSEFFAKKLLDTTKESLDREVTDYQIDYTAKLVECVSDELYPMEKQELLNIVTTAKKLSQDRNLLQDIDFSAINRENGWIGSRGIEGTEGNINFKSRSVRLPGARNIDGKIDSTYFYQKINASKLKPYTRYELRGRIESSKKLEIYLIHHNANRIIKNVNGNNSLLNSYNEIDPCISKCSNHILSIEEAELDMNNHTNFHEFSLCIDTGELDLNKNIGIWVAFKISDLNGYAELRNIECIEVEPLFGEALEKLKKQEQEWTRTENKQYEESKKIRAVAIKAVEQLFEDSSYQKLRPELDLSNISKAENLVNSIPYVSNDWFSYVPGINHNTVEELKTKIQLAFALYRHRNSIQNGDFKNGLNSWTVTSDVVVEENQIDPELVISNWSSQVSQDVVVEANHRYLLRVTAKKENVGIGYITIHDSTDNSKSIVFDDCEKNQDHYVTKTTEFIPSTDKVYIKIHETDGIFRIKNIDFTLNKK

SEQ ID NO: 389 - protein, 1177 aa, Lysinibacillus sphaericus IAB59
MDINNNNEKEIINSHLLPYSLLKKYPIKSLQSTNYKDWLNLCQDFNKDIESYDLVTAVSSGTIVVGTMLSAIYAPALIAGPIGIIGAIIISFGTLLPLLWNESENNPKTTWIEFIRMGEQLVDKTISQTVFNILESYLKDLKVNLVDYEKAKQDWIELKKQQLPGSPPSTKLRNAADIAHQRLDSLHNKFAELNKFKVEPYETILLPVYAQAANLHLNLLQQGAMFADQWIEDKYSSRNDTFAGNSNDYQNLLKSRTITYINHIENTYQNGLNYLWNQPEMTWDIYNEYRTKMTITALDLMALFPFYNKELYDPTVGIKSELTREIFINTPVEPHLHRYFKLSETEEKLTNNSDLFKWLTSLKFRTLYQPGFPFLIGNMNSFTNTNGTQLINNQQQLWSFPGTTENEEKLFPSPANIDQVTMYIYYGSGWGIPEPISTTINKLIFNHDKHELISEYDAGNTNAPTRSLSLGLPNHYLSCLNSYYPLTATTDGMNKEELKMYSFGWTHNSVDFLNEISKDKITQIPAVKAYRLTSNSRVIKGPSHIGGNLVYLSENSQMALTCRYTNSSPQEYKIRIRYASNRLNMGQLFTTFSSHQFVLPPTFNHFNIEQAKYEDYAYAEFPESMSIRGNLNSDILLILNILAGGELLLDKIEFIPLTQKVKDNLEKEKIDMLKNLTDSLFNSPSKDTLKIDSTDYQIDQIAFQIESINEEINPQEKMELLDNIKYAKKLNQLRNLLYSRESQAQIDWVTSNDVSIYHGKKPFNDYTLVMSRTSSSLSEITATNYQTYIYKKIEESKLKPYTRYLVRGFISNSEDLEIFISRYENEIHTNMNVHGDDDTLLNSDIRQNECESKLPIIFDATSQYSLSPSRTSGISNHSYYNNGHQSSCNDTHIFSFSIDTGEVDFNNYPGIEILFKLSNTNGYASISNLEVIEERLLTEEEKRQIIQIENRWKAKKESQRNETEKITTQAQQAINSLFTDTQYSNLKFETTKQNITEANTILENIPYVYNALLPTEPGMNFVLFNSFKDQINKAHALYKMRNLIKNGDFINDTKYWSISTDVKLEKVNKETILVLSSWEAQASQQILVQKQKRYLLRVIAKKEDMGRGNVIISDCLNNIAKIDFTPHDCNMNHIQNSSEFIIKTIHFSPNTEQVRIDIGQSDGVFKVESIELICVNY

SEQ ID NO: 390 - protein, 1177 aa, Lysinibacillus sphaericus 47-6B; identical to SEQ ID NO: 389

SEQ ID NO: 391 - protein, 1177 aa, Lysinibacillus sphaericus NHA15b; identical to SEQ ID NO: 389

SEQ ID NO: 392 - protein, 1129 aa, Lysinibacillus sphaericus LP1G
MDINNNNEKEIINSHLLPASLLKKHPIKSLQSTNYKDWLNLCQDFNKDIESYDLVTAVSSGTIVVGTMLSAIYAPAIIAGPIGVIGAIIISFGTLLPLLWSEDENNPKTVWIEFIRMGERLVDKTISQTVLNILESYLKDLKVNLIDYEKAKQDWIELKKQQLPGSPPSINLRNAADIAHQRLDSLHNKFAELNVFKVASYETILLPVYAQAANLHLNLLQQGAMFADQWIEDKYSPRNDTFAGNSNDYQDLLKSRTITYINHIENTYKDGLNYLWNQPEMTWDIYNEYRTNMTLTALDLLPLFPFYNKELYDPRVGIKSELTREVYINTPVDPHLHRYFKLGETEDKLTNNSELFKWLTSLKFRTFNQPGFPFLIGNMNYFKKTNGTQLINNQQQLWSFPGTTEIEKLFPSPANIDKVTMYIYYGSGWEVPEPISITINKLIFNHHKHGLITEYDAGNTNAPTMGIYVNLPKHYLSCLNSYYPLTATTNGMGKEELKMYSFGWTHESVDFLNEISNDKITQIPAVKAYNLNSNSRVIKGPGHIGGNLVYLSDKSQLSLACRYTNSSPQDFLIRIRYASNKRNMVQLFTPFSTHQFVLPQTFNHLNIEQTKYEDYEYAQLPGSLTINGNVNIDLLFLLNVLDGGELLLDKIEFIPLTQKVKDNLEKEKIDMLKNLTDSLFNSPAKDTLKINSTDYQIDQIAFQIESINEEINTQEKMKLLDNIKYAKKLNQLRNLLYSRESQAQIDWVTSNDVSIYHGKKPFNEYTLVMSGSSLSKITSSNYPTYIYKKIEESKLKPYTRYLVRGFISNSDNLEIFISRYENEIHTNMNVHVDDDTLLNSYKRQNECESKLPIVFDETSQYPLSPSRTSGISNHSYYNGAQQSSCHDTQIFSFSIDTGDVDFNEYPGIEILFKLSNSNGYASISNLEVIEERLLTEEEKRHIIEIENRWKAKKEIQRNETEKETTQAQQAINNLFTDTQYSKLKFETTKQSISKANAILENIPYVYNSLLPTEPGMNFELFNSFKDQINKAHTLYKMRNSIKNGDFINGTEYWSISTDVKLEKTNIETILVMSSWSAQSSQQILVQKQNRYLLRVIAKKEDMGSGNVTISDCLNNIAKIEFIPHDCNMN

SEQ ID NO: 393 - protein, 1129 aa, Lysinibacillus sphaericus 2173
MDINNNNEKEIINSHLLPASLLKKHPIKSLQSTNYKDWLNLCQDFNKDIESYDLVTAVSSGTIVVGTMLSAIYAPAIIAGPIGVIGAIIISFGTLLPLLWSEDENNPKTVWIEFIRMGERLVDKTISQTVLNILESYLKDLKVNLIDYEKAKQDWIELKKQQLPGSPPSINLRNAADIAHQRLDSLHNKFAELNVFKVASYETILLPVYAQAANLHLNLLQQGAMFADQWIEDKYSPRNDTFAGNSNDYQDLLKSRTITYINHIENTYKDGLNYLWNQPEMTWDIYNEYRTNMTLTALDLLPLFPFYNKELYDPRVGIKSELTREVYINTPVDPHLHRYFKLGETEDKLTNNSELFKWLTSLKFRTFNQPGFPFLIGNMNYFKKTNGTQLINNQQQLWSFPGTTEIEKLFPSPANIDKVTMYIYYGSGWEVPEPISITINKLIFNHHKHGLITEYDAGNTNAPTMGIYVNLPKHYLSCLNSYYPLTATTNGMGKEELKMYSFGWTHESVDFLNEISNDKITQIPAVKAYNLNSNSRVIKGPGHIGGNLVYLSDKSQLSLACRYTNSSPQDFLIRIRYASNKRNMVQLFTPFSTHQFVLPQTFNHLNIEQTKYEDYEYAQLPGSLTINGNVNIDLLFLLNVLDGGELLLDKIEFIPLTQKVKDNLEKEKIDMLKNLTDSLFNSPAKDTLKIDSTDYQIDQIAFQIESINEEINTQEKMKLLDNIKYAKKLNQLRNLLYSRESQAQIDWVTSNDVSIYHGKKPFNEYTLVMSGSSLSKITSSNYPTYIYKKIEESKLKPYTRYLVRGFISNSDNLEIFISRYENEIHTNMNVHVDDDTLLNSYKRQNECESKLPIVFDETSQFPLSPSRTSGISNHSYYNGAQQSSCHDTQIFSFSIDTGDVDFNEYPGIEILFKLSNSNGYASISNLEVIEERLLTEEEKRHIIEIENRWKAKKEIQRNETEKETTQAQQAINNLFTDTQYSKLKFETTKQSISKANAILENIPYVYNSLLPTEPGMNFELFNSFKDQINKAHTLYKMRNSIKNGDFINGTKYWSISTDVKLEKTNIETILVMSSWSAQSSQQILVQKQNRYLLRVIAKKEDMGSGNVTISDCLNNIAKIEFIPHDCNMN

SEQ ID NO: 394 - protein, 464 aa, Lysinibacillus sphaericus IAB59
MENQIKEEFNKNNHGIPSDCSCIKEGDDYNSLTEINAKEFSYCSPNMFNLNLPEQSTRFQTIASIHSNNCSFEILNNDPGYIYGDSVDGECRIAVAHRELGNGLERTGDDRFLFIFYALDNNNFIIANRHDGFVLQFLIANGQGVIVSREYQPNIHQEFTIQSINSDTFRLHSRDTNTFATVCWAQFNSWTKIVSRVDNPGAPNANLKHRSLLTDINMPQLPSLTPLQPLPRLTELEDGGLSPAQAPRAIIGRTLIPCLFVNDPVLRLENRIKQSPYYVLEHRQYWHRIWTDIFTAGERREYREVTGINNNAQNDMNKMINITIGADGPNRLRFGNLSTPFRQQIIDNSNTLGSFANTNYGTRTDIVNVFNSEFHQVRYARFVKAYEYRLTRADGSQVGTPWVVLDRKEMDLRTYPHNMAITLENVKIDNADNSYDLSIWKTPLKLKDGKIIIENHENSKPYYN

SEQ ID NO: 395 - protein, 464 aa, Lysinibacillus sphaericus 47-6B; identical to SEQ ID NO: 394

SEQ ID NO: 396 - protein, 464 aa, Lysinibacillus sphaericus NHA15b; identical to SEQ ID NO: 394

SEQ ID NO: 397 - protein, 464 aa, Lysinibacillus sphaericus 2173; identical to SEQ ID NO: 394

SEQ ID NO: 398 - protein, 467 aa, Lysinibacillus sphaericus LP1G
MENQIKEEFNKNNHGIPSDCSCIKEGDDYNSLTEVPSEINAKEFSYCSPNMFNLNLPEQSTRFQTIGSIHSNNCSFEILNNDPGYIYGDSVAGECRIAVAHRELGNGLERTGDDRFLFIFYALDNNNFIIANRHDGFVLQFLIANGQGVIVSREYQPNIRQEFTIQSINSDTFRLHSRDTNTFATVCWAQFNSWTKIVSRVDNPGAPNADLRHRSFLDINMPQLPSLTPLQPLPRLTGLEDGGLSPAQAPRAIIGRTLIPCLFVNDPVLRLESRIKQSPYYVLEHRQYWHRLWTDIFNAGERREYREVTGINHNAQNDMNNMINITIGSDGPNRLLFGHLSTPFRQQIISNSNTLGSFANSNYSSRTESITYLNTEFHQVRFARFVKAYEYRLTRADGTLVGTPWVVLDRKEMDLRTFPHNMTLNLENVKIVNADNSYDLSVWKTPLKLKDGKIIIENHENSKPYYN

SEQ ID NO: 399 - protein, 1180 aa, Bacillus thuringiensis israelensis
MNPYQNKNEYETLNASQKKLNISNNYTRYPIENSPKQLLQSTNYKDWLNMCQQNQQYGGDFETFIDSGELSAYTIVVGTVLTGFGFTTPLGLALIGFGTLIPVLFPAQDQSNTWSDFITQTKNIIKKEIASTYISNANKILNRSFNVISTYHNHLKTWENNPNPQNTQDVRTQIQLVHYHFQNVIPELVNSCPPNPSDCDYYNILVLSSYAQAANLHLTVLNQAVKFEAYLKNNRQFDYLEPLPTAIDYYPVLTKAIEDYTNYCVTTYKKGLNLIKTTPDSNLDGNINWNTYNTYRTKMTTAVLDVVALFPNYDVGKYPIGVQSELTREIYQVLNFEESPYKYYDFQYQEDSLTRRPHLFTWLDSLNFYEKAQTTPNNFFTSHYNMFHYTLDNISQKSSVFGNHNVTDKLKSLGLATNIYIFLLNVISLDNKYLNDYNNISKMDFFITNGTRLLEKELTAGSGQITYDVNKNIFGLPILKRRENQGNPTLFPTYDNYSHILSFIKSLSIPATYKTQVYTFAWTHSSVDPKNTIYTHLTTQIPAVKANSLGTASKVVQGPGHTGGDLIDFKDHFKITCQHSNFQQSYFIRIRYASNGSANTRAVINLSIPGVAELGMALNPTFSGTDYTNLKYKDFQYLEFSNEVKFAPNQNISLVFNRSDVYTNTTVLIDKIEFLPITRSIREDREKQKLETVQQIINTFYANPIKNTLQSELTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDIRNIIKNGDFTQGVMGWHVTGNADVQQIDGVSVLVLSNWSAGVSQNVHLQHNHGYVLGVIAKKEGPGNGYVTLMDWEENQEKLTFTSCEEGYITKTVDVFPDTDRVRIEIGETEGSFYIESIELICMNE

SEQ ID NO: 400 - protein, 1180 aa, Bacillus thuringiensis israelensis HD522
MNPYQNKNEYETLNASQKKLNISNNYTRYPIENSPKQLLQSTNYKDWLNMCQQNQQYGGDFETFIDSGELSAYTIVVGTVLTGFGFTTPLGLALIGFGTLIPVLFPAQDQSNTWSDFITQTKNIIKKEIASTYISNANKILNRSFNVISTYHNHLKTWENNPNPQNTQDVRTQIQLVHYHFQNVIPELVNSCPPNPSDCDYYNILVLSSYAQAANLHLTVLNQAVKFEAYLKNNRQFDYLEPLPTAIDYYPVLTKAIEDYTNYCVTTYKKGLNLIKTTPDSNLDGNINWNTYNTYRTKMTTAVLDLVALFPNYDVGKYPIGVQSELTREIYQVLNFEESPYKYYDFQYQEDSLTRRPHLFTWLDSLNFYEKAQTTPNNFFTSHYNMFHYTLDNISQKSSVFGNHNVTDKLKSLGLATNIYIFLLNVISLDNKYLNDYNNISKMDFFITNGTRLLEKELTAGSGQITYDVNKNIFGLPILKRRENQGNPTLFPTYDNYSHILSFIKSLSIPATYKTQVYTFAWTHSSVDPKNTIYTHLTTQIPAVKANSLGTASKVVQGPGHTGGDLIDFKDHFKITCQHSNFQQSYFIRIRYASNGSANTRAVINLSIPGVAELGMALNPTFSGTDYTNLKYKDFQYLEFSNEVKFAPNQNISLVFNRSDVYTNTTVLIDKIEFLPITRSIREDREKQKLETVQQIINTFYANPIKNTLQSELTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 401 - protein, 1180 aa, Bacillus thuringiensis israelensis; identical to SEQ ID NO: 400

SEQ ID NO: 402 - protein, 1180 aa, Bacillus thuringiensis s. israelensis BRC-LLP29; identical to SEQ ID NO: 400

SEQ ID NO: 403 - protein, 145 aa, Bacillus thuringiensis LDC-9
SSLNFQQSYFIRIRYASNGSANTRAVINLSIPGVAELGMALNPTFSGTDYTNLKYKDFQYLEFSNEVKFAPNQNISLVFNRSDVYTNTTVLIDKIEFLPITRSIREDREKQKLETVQQIINTFYANPIKNTLQSELTDYDIDQGG

SEQ ID NO: 404 - protein, 1136 aa, Bacillus thuringiensis israelensis 4Q2-72
MNSGYPLANDLQGSMKNTNYKDWLAMCENNQQYGVNPAAINSSSVSTALKVAGAILKFVNPPAGTVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGLINAQEWSLARSAGDQLYNTMVQYTKEYIAHSITWYNKGLDVLRNKSNGQWITFNDYKREMTIQVLDILALFASYDPRRYPADKIDNTKLSKTEFTREIYTALVESPSSKSIAALEAALTRDVHLFTWLKRVDFWTNTIYQDLRFLSANKIGFSYTNSSAMQESGIYGSSGFGSNLTHQIQLNSNVYKTSITDTSSPSNRVTKMDFYKIDGTLASYNSNITPTPEGLRTTFFGFSTNENTPNQPTVNDYTHILSYIKTDVIDYNSNRVSFAWTHKIVDPNNQIYTDAITQVPAVKSNFLNATAKVIKGPGHTGGDLVALTSNGTLSGRMEIQCKTSIFNDPTRSYGLRIRYAANSPIVLNVSYVLQGVSRGTTISTESTFSRPNNIIPTDLKYEEFRYKDPFDAIVPMRLSSNQLITIAIQPLNMTSNNQVIIDRIEIIPITQSVLDETENQNLESEREVVNALFTNDAKDALNIGTTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 405 - protein, 1136 aa, Bacillus thuringiensis israelensis
MNSGYPLANDLQGSMKNTNYKDWLAMCENNQQYGVNPAAINSSSVSTALKVAGAILKFVNPPAGTVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGLINAQEWSLARSRGDQLYNTMVQYTKEYIAHSITWYNKGLDVLRNKSNGQWITFNDYKREMTIQVLDILALFASYDPRRYPADKIDNTKLSKTEFTREIYTALVESPSSKSIAALEAALTRDVHLFTWLKRVDFWTNTIYQDLRFLSANKIGFSYTNSSAMQESGIYGSSGFGSNLTHQIQLNSNVYKTSITDTSSPSNRVTKMDFYKIDGTLASYNSNITPTPEGLRTTFFGFSTNENTPNQPTVNDYTHILSYIKTDVIDYNSNRVSFAWTHKIVDPNNQIYTDAITQVPAVKSNFLNATAKVIKGPGHTGGDLVALTSNGTLSGRMEIQCKTSIFNDPTRSYGLRIRYAANSPIVLNVSYVLQGVSRGTTISTESTFSRPNNIIPTDLKYEEFRYKDPFDAIVPMRLSSNQLITIAIQPLNMTSNNQVIIDRIEIIPITQSVLDETENQNLESEREVVNALFTNDAKDALNIGTTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 406 - protein, 1135 aa, Bacillus thuringiensis israelensis
MNSGYPLANDLQGSMKNTNYKDWLAMCENNQQYGVNPAAINSSSVSTALKDAGAILKFVNPPAGSVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGPHKCTRMVYARSCDQLYNTMVQYTKEYIAHSITWYNKGLDVLRNKSNGQWITFNDYKREMTIQVLDILALFASYDPRRYPADKIDNTKLSKTEFTREIYTALVESPSSKSIAALEAALTRDVHLFTWLKRVDFWTNTIYQDLRFLSANKIGFSYTNSSAMQESGIYGSSGLVQIYLIKFNLILIVIKLLSQILAPPLIELQKWISTKFDGTLASYNSNITPTPEGLRTTFFGFSTNENTPNQPTVNDYTHILSYIKTDVIDYNSNRVSFAWTHNIVDPNNQIYTDAITQVPAVKSNFLNATARVIKGPGHTGGDLVALTSNGTLSGGRMEIQCKTSIFNDPTRSYGLRIRYAANSPIVIECDHMYYKEFLEEQRLVQNYVSRPNNIIPTDLKYEEFRYKDPNDAIVPMRLSSNQLITIAIQPLNMTSNNQVIIDRIEIIPITQSVLDETENQNLESEREVVNALFTNDAKDALNIGTTDYDIDQAANLVECISEGIISKEKMLLLDEVKNAKQLSQSRNVLQNGDFESRTLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGLIVVSVRCAANIWDTSDMLYSCQYDTGKKHVVCQDSHQFSFTIDTGALDTNENIGVWVMFKISSPDGYASLDNLEVIERGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNVDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 407 - protein, 1135 aa, Bacillus thuringiensis israelensis HD522
MNSGYPLANDLQGSMKNTNYKDWLAMCENNQQYGVNPAAINSSSVSTALKVAGAILKFVNPPAGTVLTVLSAVLPILWPTNTPTPERVWNDFMTNTGNLIDQTVTAYVRTDANAKMTVVKDYLDQYTTKFNTWKREPNNQSYRTAVITQFNLTSAKLRETAVYFSNLVGYELLLLPIYAQVANFNLLLIRDGLINAQEWSLACAGDQLYNTMVQYTKEYIAHSITWYNKGLDVLRNKSNGQWITFNDYKREMTIQVLDILALFASYDPRRLPADKIDNTKLSKTEFTREIYTALVESPSSKSIAALEAALTRDVHLFTWLKRVYFWTNTIYQDLRFLSANKIGFSYTNSSAMQESGIYGSSGFGSNLTHQIQLNSNVYKTSITDTSSPSNRVTKMDFYKIDGTLASYNSNITPTPEGLRTTFFGFSTNENTPNQPTVNDYTHILSYIKTDVIDYNSNRVSFAWTHKIVDPNNQIYTDAITQVPAVKSNFLNATAKVIKGPGHTGGDLVALTSNGTLSGRMEIQCKTSIFNDPTRSYGLRIRYAANSPIVLNVSYVLQGVSRGTTISTESTFSRPNNIIPTDLKYEEFRYKDPFDAIVPMRLSSNQLITIAIQPLNMTSNNQVIIDRIEIIPITQSVLDETENQNLESEREVVNALFTNDAKDALNIGTTDYDIDQAANLVECISEELYPKEKMLLLDEVKNAKQLSQSRNVLQNGDFESATLGWTTSDNITIQEDDPIFKGHYLHMSGARDIDGTIFPTYIFQKIDESKLKPYTRYLVRGFVGSSKDVELVVSRYGEEIDAIMNVPADLNYLYPSTFDCEGSNRCETSAVPANIGNTSDMLYSCQYDTGKKHVVCQDSHQFSFTIDTGALDTNENIGVWVMFKISSPDGYASLDNLEVIEEGPIDGEALSRVKHMEKKWNDQMEAKRSETQQAYDVAKQAIDALFTNVQDEALQFDTTLAQIQYAEYLVQSIPYVYNDWLSDVPGMNYDIYVELDARVAQARYLYDTRNIIKNGDFTQGVMGWHVTGNADVQQIDGVSVLVLSNWSAGVSQNVHLQHNHGYVLRVIAKKEGPGNGYVTLMDCEENQEKLTFTSCEEGYITKTVDVFPDTDRVRIEIGETEGSFYIESIELICMNE

SEQ ID NO: 408 - protein, 1136 aa, Bacillus thuringiensis israelensis; identical to SEQ ID NO: 404

SEQ ID NO: 409 - protein, 79 aa, Bacillus thuringiensis LDC-9
MKSLHKDPFEAIVPMTLSSNQLITIAIQPLNMTSNNQVIIDRIEIIPITQSVLDETENQNLESEREVVNALFTNDAKDA

SEQ ID NO: 410 - protein, 1230 aa, Bacillus thuringiensis Y41
MNSYENKNEYEILDASQNNSNMSNRYQRYPLAHNPQTSIQTTNYKDWLRMCENPLDMEGYDSNSVVVVSTGLIVVGTLISILSAGLGSIPIIYGTLLPVLWNDPNNPQKTWHEFMSHGETLLNQTISTVERNRAAAYLEGYTTAVKKCEEALNVWLKTPNQANARTVADLYKDTDFLFFTTLPHLKLRGYETLLLSSYTQAANMHLILLKQASKYADQWNAQLSVSVQKTANDYYTDLVKLIGEYTDYCIATYRLGLTTIKSRATSWNIYNMYRREMTILVLDLVALFPAHDIKKYPSGTKVELTREIYTDALGAVALPQNIDATEQLATRAPNLFSWLKGFKFITTQSTNRYYLSGIANQYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCIQNCNPTFNNYSHILSYAKTFTSNLTIGTTANITSFGWTHNSVDRENTIDLNNITQIPAVKASQVYPENSVIKGPGHTGGNLVRIDSSGYMSIVCKFPLQVKGYRVRIRYAANNRAELYISSAGNSPSKNVDLDPTFSGTNYESLNYTNFKDKETEFIITEGQLVKQSIIFSTNGNVLLDKIEFIPLGTTTYEYEEKQNLEKAQKALNALFTDSTNGYLQMDTTDYDINQTASLIECVSDELYAKEKIVLLDEVKYAKRLSISRNLLLKDDLEFSAGFGENGWTTSDNISIQADNPIFKGNYLKMFGARDIDGILFPTYLYQKIEESKLKPYTRYRVRGFVGSSKDLKLVVTRYEKEIDAIMNVPNDLAHMQLNPSCGDYRCESSSQFLVNQVHPTPTAGYALDRYARPSSSDKKHIMCHDRHPFDFHIDTGELNPNTNLGIDVLFKISNPNGYATLGNLEVIEEGPLTDEALVHVKQKEKKWRQHMEKKRMETQQAYDPAKQAVDALFTNEQELDYHITLDYIKNADQLVQAIPYVHHAWLPDAPGMNYDVYQGLNARIMQAYNLYDARNIIINGDFTQGLQGWHATGKAAVQQIDGASVLVLSNWSAEVSQNLHAQDHHGYMLRVIAKKEGPGKGYVTMMDCNGKQETLTFTSCEEGYITKTIEVFPESNRIRIEMGETEGTFYVDSIELLCMQGYASNNNPHTGNMYEQSYNGNYNQNTSDVYHQGYINNYNQNSSSMYNQNYINNDDLHSGCTCNQGHNSGCTCNQGYNR

SEQ ID NO: 411 - protein, 1157 aa, Bacillus thuringiensis HS18-1
MNSYQNKNEYEILDASQNNSNMSNRYQRYPLAHNPQTSIQTTNYKDWLKMCQNPHQNPLDMEGYDSNSVVVVSTGLIVVGTLISILSAGLGSIPIIYGTLLPVLWNDPNNPQKTWHEFMSHGETLLNQTISTVERNRAAAYLEGYTTAVKNVKKHLNVWLKTPNQANARTVADLYKDTDFLFFTTLPHLKLRGYETLLLSSYTQAANMHLILLKQASKYADQWNAQLSVYVQKTANDYYTDLVKLIGEYTDYCIATYRLGLTTIKSRATSWNIYNMYRREMTILVLDLVALFPAHDIKKYPSGTKVELTREIYTDALGAVALPQNIDAIEQLATRAPNLFSWLKGFKFITTQSTNRYYLSGIANQYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCTQNCNPTFNNYSHILSYAKTFTSNLTIGTTSNIHFVWLDAQSVDRENTIDLNNITQIPAVKASQVYPENSVIKGPGHTGGNLVRIDSSGYMSIVCKFPLQVKGYRVRIRYAANNRAELYISSAGNSPSKNVDLDPTFSGTNYESLNYTNFKDKETEFIITEGQLVKQSIIFSTNGNVLLDKIEFIPLGTTTYEYEEKQNLEKARKALNALFTDGTNGYLQMDTIDYDINQTANLIECVSDELYAKEKIVLLDEVKYAKRLSISRNLLSKDYLEFSDVFEENGWTTSDNISIQADNPIFKGNYLKMFGARDIDGTLFPTYLYQKIEESKLKPYTRYRVRGFVGSSKDLKLVVTRYEKEIDAIMNVPNDLAHMQLNPSCGDYRCESSSQFLVNQVHPTSTAGYALDMYACPLSSDKNHVMCHDRHPFDFHIDTGEVGTNTNVGIDVLFKISNPDGYATVGNLEVIEEGPLTGDALAHVKHKEKKWKQHMEKKRWKTQQAYDPAKQAVDALFTNEQELHYHITLDHIQNADRLIQAIPYVYHAWLPSAPGMNYDGYQGLNARIMQARYLYDARNIITNGDFTQGLTGWHAAGKATVQQMNGASVLVLSNWSAGVSQNLHVQDHHGYVLRVIAKKEGPGKGYVTMMDCNGNQETLKFTSCEEGYMTKTVEVFPESDRVRIEMGETEGTFYIDSIELICMNE

SEQ ID NO: 412 - protein, 1136 aa, Bacillus thuringiensis Ywc2-8
MSNRYQRYPLAHNPQTSIQTTNYKDWLKMCQNPHQNPLDMEGYDSNSVVVVSTGLIVVGTLISILSAGLGSIPIIYGTLLPVLWNDPNNPQKTWHEFMSHGETLLNQTISTVERNRAAAYLEGYTTAVKKCEEALNVWLKTPNQANARTVADLYKDTDFLFFTTLPHLKLRGYETLLLSSYTQAANMHLILLKQASKYADQWNAQLSVYVQKTANDYCTDLVKLIGEYTDYCIATYRLGLTTIKSRATSWNIYNMYRREMTILVLDLVALFPAHDIKKYPSGTKVEPTREIYTDALGAVALPQNIDAIEQLATRAPNLFSWLKGFKFITTQSTNRYYLSGIANQYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCTQNCNPTFNNYSHILSYAKTFTSNLTIGTTSNITSFGWTHNSVDRENTIDLNNITQIPAVKASQVYPENSVIKGPGHTGGNLVRIDSSGYMSIVCKFPLQVKGYRVRIRYAANNRAELYISSAGNSPSKNVDLDPTFSGTNYESLNYTNFKYKETEFIITEGQLVKQSIIFSTNGNVLLDKIEFIPLGTTTYEYEEKQNLEKARKALNALFTDGTNGYLQMDTTDYDINQTANLIECVSDELYAKEKIVLLDEVKYAKRLSISRNLLSKDYLEFSDVFEENGWTTSDNISIQADNPIFKGNYLKMFGARDIDGTLFPTYLYQKIEESKLKPYTRYRVRGFVGSSKDLKLVVTRYEKEIDAIMNVPNDLAHMQLNPSCGDYRCESSSQFLVNQVHPTPTAGYALDMYACSLSSDKKHVMCHDRHPFDFHIDTGEAGTNTNVGIDVLFKISNPDGYATVGNLEVIEEGPLTGDALAHVKHKEKKWKQHMEKKRWKTQQAYDPAKQAVDALFTNEQELHYHITLDHIQNADRLIQAIPYVYHAWLPSAPGMNYDGYQGLNARIMQARYLYDARNIITNGDFTQGLTGWHAAGKATVQQMNGASVLVLSNWSAGVSQNLHVQDHHGYVLRVIAKKEGPGKGYVTMMDCNGNQETLKFTSCEEGYMTKTVEVFPESDRVRIEMGETEGTFYIDSIELICMNE

SEQ ID NO: 413 - protein, 1157 aa, Bacillus thuringiensis MC28
MNSYQNKNEYEILDASQNNSNMSNRYQRYPLAHNPQTSIQTTNYKDWLKMCQNPHQNPLDMEGYDSNSVVVVSTGLIVVGTLISILSAGLGSIPIIYGTLLPVLWNDPNNPQKTWHEFMSHGETLLNQTISTVERNRAAAYLEGYTTAVKNVKKHLNVWLTAPNQANARTVADLYKDTDFLFFTTLPHLKLRDFETLLLSSYTQAANMHLILLKQASKYADQWNAQLPVSVRKTANDYYTDLVKLIGEYTDYCIATYRSGLNTIKSRATSWNIYNMYRREMTILVLDLVALFPAYDIKKYPSGTKVELTREIYTDALGAVAIPQNIDATEQLATRAPNLFSWLKGFKFITTQSTNRYYLSGIANRYSFTNSNGEIWGPISGNPTGVSSDLTIDNNFSIYKLSILRGYQLSPDFSFHNPVHQIDFSTTNNQQGRVQSYKSGGPTPVNPETTAIHLPIDSKCTQNCNPTFNNYSHILSYAKTFTSNLTIGTTSNITSFGWTHNSVDRENTIDLNNITQIPAVKASQVYPENSVIKGPGHTGGNLVRIDSSGYMSIVCKFPLQVKGCRVRIRYAANNRAELYISSAGNSPSKNVDLDPTFSGTNYESLNYTNFKDKETEFIITEGQLVKQSIIFSTNGNVLLDKIEFIPLGTTTYEYEEKQNLEKAQKALNALFTDGTNGYLQMDATDYDINQTANLIECVSDELYAKEKIVLLDEVKYAKRLSISRNLLLNDDLEFSDGFGENGWTTSDNISIQADNPLFKGNYLKMFGARDIDGTLFPTYLYQKIDESRLKPYTRYRVRGFVGSSKNLKLVVTRYEKEIDAIMNVPNDLAHMQLNPSCGDYRCESSSQFLVNQVHPTPTAGYAPDMYACPSNSDEKHVMCHDRHPFDFHIDTGELNPNTNLGIDVLFKISNPNGYATLGNLEVIEEGPLTDEALVHVKQKEKKWRQHMEKKRMETQQAYDPAKQAVDALFTNEQELHYHITLDHIQNAGRLVQLIPYAHHAWLLDVPGMNYDVYTELNVRITQARYLYKERNVITNGDFTQGLTGWQETGKATVQQMDGASVLVLSNWSAGVSQNLHVQDQHGYVLRVTAKKEGPGKGYVTMMDCNGKQETLRFTSCEEGYMTKTVEVFPESDHVRIEMGETEGTFYIDSIEFLCMKG

SEQ ID NO: 414 - protein, 679 aa, Bacillus thuringiensis sotto
MNLYQNKNEYEILDASRNNSNMSNSYLRYPLESNPNQPLQKTNYKDWVNMCKGNPGGFLLSDEQYVAIVGTVISKLLGFVPVVGDILSFLADTYWPKIAGQEVDTRVWAGLIRHTANLISVENYQDALIKATTNLMGLYGALNVYNRFLADWKKSGMVFNGTLADELRKQMSTLHLMFTQTIIRDFSQPGYQAILLPSYTSAANLHLLLLRDIEIYGKELGFSQQVLDSYYRELILFTKEYTTHCVDTYNAALNAQKQKGWIAFNHYRRNMTLTVLDVITLFPSYDARKYPADKKDVKKLSKTELTREIYTAFLETSPNQTVEIMEASLTRDPHIFTWIKRLDFWTDTLYPDNKFLSANRNGFSYTNSSTVQESIVYGDSGFGSTLTHAIPINSNIYKVSITDTRSIPNRIPQVDFHKMDGTLTSYSSGIKLPPEELRTTFFGFSTNENTPNQPNSSDYTHILTYMKTGIISGGAPKRVSLAWAHKSVNPYNQIFTDDITQVPAVKSSLLNVQAKVIKGPGHTGGDLVALINNNLQAGRMDITCKTSNFNESERRYGLRIRYAANNSFSIYVSYVSSEGSIRQTSRIIESTFSRPNNIIPTDLKYDEFKYNEAFDAILPVRLSPNQSTTISIYQTNALPANQLIIDRIEFIPITQSVLDYTEKQNLEKSQKTVNNLFVS

SEQ ID NO: 415 - protein, 679 aa, Bacillus thuringiensis S2160-1
MNSYQNTNEYEILDASPSYSNMTNSYPRYPLANNRQGSMKNTNYKDWLAMCEGNVEGLFLTDEQMVSIVGAAISKLLGFVPVVGDILSSLADTYWPKIAGQEADTRVWAGLIRHTANLIDNRDVDRVIGQATANVMSLYAALGVYNRFLEQWKSPVKPYAGLADEIRAQMSTLHLLFTTKIISDFTIQGYEAILLPSYANAASLHLLLLRDISIYGEKLGFDSKTLQAYHNEQVKFTTDYTAHCIKTYNLNLNAQKSKGWVAFNQYRRDMTLTVLDLIALFPSYDTHRYPADEKNVKKLSNTELTREIYTALTESSPSKTVEAMEESLTRGPHLFTWPKRLDFWTFNYNMYPDTRYLSANRIGFSYTNSSEIEDSGIYGSPTFGTVLTHQIPLNSNVYRTSITDTTAVPNQVTKMDFYKIDGTNASYNSNITPVPANLRTTFFGFSSDANRPPNQPTVQDYNNILSYIKTDIIGGHQARVSFAWTHKGVNPNNQILTDNVTQVPAVKSSLLNAPARVIKGPGHTGGDLVALLNNGTQAGTMQIQCKTGSFTETSRRYGIRMRYAANNAFTVSLSYTLQGGNPIGITFGTERTFSRTNNIIPTDLKYEEFKYKEYNQIITMNSPQNTIVTIDIRQLNPSSNDQLIIDRIEFIPITQSVLDYTEEQNLETAQAVVDNLFTN

SEQ ID NO: 416 - protein, 679 aa, Bacillus thuringiensis S3161-3
MNSYQNTNEYEILDASPSYSNMTNSYPRYPLANNRQGSMKNTNYKDWLAMCEGNAEGLFLTDEQMVSIVGAAISKLLGFVPVVGDILSSLADTYWPKIAGQEADTRVWAGLIRHTANLIDNRDVDRVIGQATANVMSLYAALGVYNRFLEQWKSPVKPYAGLADEIRAQMSTLHLLFTTKIISDFPIQGYESILLPSYANAASLHLLLLRDISIYGEKLGFDSKTLQAYHNEQVKFTTDYTAHCIKTYNLNLNAQKSKGWVAFNQYRRDMTLTVLDLIALFPSYDTHRYPADEKNVKKLSNTELTREIYTALTESSPSKTVEAMEESLTRGPHLFTWPKRLDFWTFNYNMYPDTRYLSANRIGFSYTNSSEIEDSGIYGSPTFGTVLTHQIPLNSNVYRTSITDTTAVPNQVTKMDFYKIDGTNASYNSNITPVPANLRTTFFGFSSDANRPPNQPTVQDYNNILSYIKTDIIGGHQARVSFAWTHKGVNPNNQILTDNVTQVPAVKSSLLNAPARVIKGPGHTGGDLVALLNNGTQAGTMQIQCKTGSFTETSRRYGIRMRYAANNAFTVSLSYTLQGGNPIGITFGTERTFSRTNNIIPTDLKYEEFKYKEYNQIITMNSPQNTIVTINIRQLNPSSNDQLIIDRIEFIPITQSVLDYTEEQNLETAQAVVDNLFTN

SEQ ID NO: 417 - protein, 309 aa, Bacillus thuringiensis F14-1
MIFLAILDLKSLVLNAINYWGPKNNNGIQGGDFGYPISEKQIDTSIITSTHPRLIPHDLTIPQNLETIFTTTQVLTNNTDLQQSQTVSFAKKTTTTTSTSTTNGWTEGGKISDTLEEKVSVSIPFIGEGGGKNSTTIEANFAHNSSTTTFQQASTDIEWNISQPVLVPPRKQVVATLVIMGGNFTIPMDLMTTIDSTEHYSGYPILTWISSPDNSYNGPFMSWYFANWPNLPSGFGPLNSDNTVTYTGSVVSQVSAGVYATVRFDQYDIHNLRTIEKTWYARHATLHNGKKISINNVTEMAPTSPIKTN

SEQ ID NO: 418 - protein, 309 aa, EG2934
MAILDLKSLVLNAINYWGPKNNNGIQGGDFGYPISEKQIDTSIITFTHPRLIPYDLTIPQNLETIFTTTQVLTNNTDLQQSQTVSFAKKTTTTTSTSTTNGWTEGGKISDTLEEKVSVSIPFIGEGGGKNSTTIEANFAHNSSTTTFQQASTDIEWNISQPVLVPPSKQVVATLVIMGGNFTIPMDLMTTIDSTEHYSHYSGYPILTWISSPDNSYSGPFMSWYFANWPNLPSGFGPLNSDNTVTYTGSVVSQVSAGVYATVRFDQYDIHNLRTIEKTWYARHATLHNGKKISINNVTEMAPTSPIKTN

SEQ ID NO: 419 - protein, 695 aa, Bacillus thuringiensis Y41
MNFYQNTNEYEILDASQNNSTMSNRYPRYPLANNPQMPMRNTNYKDWLNMCEGNPAPLSSPSQLLKVAGNIVPRILGTLPTFFPGIGPFVPFLTFFTGLLWPSGSSGNDIWEKVMKEVADLIDQRLEENILRQATANLAGLKELLQSYNSAFATWEAGNATPGLVKGYMESLHRTFVQDIIGSFTIPNYENILLPTYAIAANFHLMLLRDIEIYGGEKTPEGKDGLNFNPKDLNFYNCELKKYKELYTNHCLNTYDKGLASEKEKGWVPFHRYRREMTLAVLDIIASFPLYDARLYPAKNNKEMSVKSELTREIYSDVINSDRFGVVPPYNYAQNEERYTRPPHLFTWLRGLDFVTNRLTSGSYSYRWYVLTGCQNKYSYTKGNGTIPGPFRGYPVESGGSASNITIEEGSYIYNLLPKSFEYISPWYFTTNIAMITFLLTNNKNDLPAKFYGSLVNQPNLPIVQTDFDFVTNKELTGPPTYNNYSHILSHMLLGYDWNQTGGIGTHGYSFAFTHSSVDPYNTIAPDKITQIPAVKAFEISDSGPGYVVAGRGDTGGDIVWLKNSARLKIRLTSATPNKNYLVRVRCMARISGNILVERWSLSSTKNDTFGVQGTLKYEYVNTLVTTFDQPGVELIIKNLTGNDMYFDKVDFIPIDIPIDKCTKCQFVGGVCTCSCPTLQSLDTEKEIVNSLFVE

SEQ ID NO: 420 - protein, 703 aa, Bacillus thuringiensis BM59-2
MNSYQNKNEYEILDASQNNSNMSNRYPRYPLANDPQASMQNTNYKDWLATCNGTPAPLYNSSQLLKISGNVVSRALGMLPIPGIAPLLSFLSTLLWPSGSSGNTIWESLMKEAADLIDQKLEENILRQATANLAGLQGLLGSYNSAFASWEAGGNATPDLVKGYMESLHRTFVQDIIGSFTIPGYEKILLPTYAITANFHLMLLRDIEIYGGKKTPEGKDGLNFDPKDLNFYNCELKKYKELYTNHCLNTYNKGLASEKEKGWVPFHRYRREMTLAVLDIIALFPLYDARLYPAKNNKEMPVKSELTREIYSDVINSDRFGVVPPYNYAQNEERYTRPPHLFTWLRGLDFVTNVLTSGTWVYRWSVLTGLSKEIFLYKREWYYNWSFSGLSCRVWWKNFQHYYCRRFLYLELVAKKLSIYFPLVFYDKYRTDYFLTNKNNSSTEKVYGYVAGNANLPTVQTDFDFLTNKEVTGPPTYNNYNHILSYLLLGYDWNQTGGIGTHGYSFAFTHSSVDPYNTIAPDKITQIPAVKAFEISDAGPSQVIAGPGHTGGDVVRLYLSGRLKIRLTPASTNKNYLVRVRYASPVSGTLRVERWSPSSVTNRDFTRLATGGFNSFGYVDTLVTTCNQSGVEIIIQNLGASDVIIDKVEFIPYDIPIDKCTKCEFEGNVCTCRCEGVQSLEKEKEIVNSLFVKENKVCTEVGG

SEQ ID NO: 421 - protein, 669 aa, Bacillus thuringiensis Y41
  MISC_FEATURE (522)..(522): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MNSYQNKNEYEILDASQNNSTMSNHYPRYPLAKDPLASMQNTNYKDWLNLCDTPNMENPEFQSVGRSALSILINLSSKILSLLGIPFAAQIGQLWSYTLNLLWPVANNATQWDIFMRTIEDLINVRIETSVRNRALAELEGLGNILEDYKVALRRWDLNPTNLDRQSEVVSQFEIVHAFFRVQMPVFAIRDFEVPLLPVYASAANLHLLLLRDVVINGDRWGLSAARINDYHDLQLRLTSTYTDHCVNWYNTGLNRLIGTNARQWVTYNQFRREMTISVLDIISLFSNYDARRYPTKTQSELTRMIYTDPIGAVGTIGLNPGWLDNAPSFSVIENSVVQSPRTFLFLERVGIFTGVLHGWSSQSQFWSAHRLFLSNLSSIWESIIYGNPQNNIGYEEVDFTNFDVFSINSRATSIMSPFGGGELFGVPRVTFDLSNRTNNSLAQRTYNRPFTFGGQDIVSRLPGETTEIPNSSNFSHRLAYISSFRVGIAGSVLSYGWTHHSVDRHMRLNPNMITQIPAVKXVSGHIVSGPGHTGGDILRVHSGSQGTIIIQSNSAQRYRLRLRYSSTLPGDLILNHRGTDGSQQFIEFTLPATSGQLRFADFTYADGRTVFQTPNSHVFYTVHVQTRSNGIFFIDKIDYIPENTPPLECGGERNLEKEKKAVNDLFTN

SEQ ID NO: 422 - protein, 668 aa, Bacillus thuringiensis MC28
MNSYQNKNEYEILDASQNNSNMSTHYPRYPLAKDPQASMQNTNYKDWLNLCDTPNMENPEFQSVGRSALSILINLSSRILSLLGIPFAAQIGQLWSYTLNLLWPVANNATQWEIFMRTIEDLINVHIETSVRNRALAELAGLGNILEDYKVVLQRWNLNPTNPTLQRDVVRQFEIVHAFFRFQMPVFAVAGFEVPLLPVYASAANLHLLLLRDVVINGARWGLESDVINDYHDLQLRLTSTYVDHCVTWYNTGLNRLIGTNARQWVTYNQFRREMTISVLDIISLFSNYDVRRYPTKIQNELTRMIYTDPVGTEGNQFIPGWLDNAPSFSVIENSVVRSPGAFTFLERVGIFTGFLHGWSSRSEFWSAHRLFSRPVLGGIWESVIFGNPQNNIGYQEVDFTNFDVFSINSRATSHMFPNGSARLFGVPQVTFNLSNINNNSPAQRIYNRQFTFGGQDIVSRLPGETTEIPNSSNFSHRLAHISSFPVGNNGSVLSYGWTHHSVNRHNRLNPDMITQIPAVKGIGGQIVSGPGHTGGDILRFNRLNQGTIVVQSNSAQRYRIRLRYSSSLPGDLILNHIGSDGSQQFIEFTLPATSGQLRFADFTYADGRTVFQTPNSHVFYTVHVQTRSDATVFIDKIDYIPENTPTLERGGERYLEKEKKVVNDLFT

SEQ ID NO: 423 - protein, 673 aa, Bacillus thuringiensis MC28
MSMKSLIQRIYLVLLTEILTILDTLLQIIRINHYKNWINMCQKNQQYGENLETFASADTIAGVSAGVIVVGTMLGAFAAPITAGLIISFGTLLPIFWKPGEDPKTVWQAFLKIGNRPFSSPVDQALIDLLSNKARSLESQFNDFQRYFDIWNNNKTPGNAGEVLRRFSSLDADIIRELEQLKGNYYITVLPGYAQVANWHLNLLRIAAFYYDQWASSSNLSIQSIYPEDYINDLQTCLTNCAIESGNKISSKYYKCVLKCRINEYINYCSKTYQEGLNILKNSSGLKWNEYNTYRREMTLNVLDLIAVFPNYDPDKYLISTKSQLTREIYTDALIDAFANAHFNINDIENSLTRPPGLVTWINRLDFYTGMFTKSVPGLTANGINYSFTNGNSNDSPIYGYRLSDDSSTPIQIPRNQYVYNMLITYLRDSPSVIQKIEFNLNNQQTRTYDTGLTLAPTYQSTINLSLPGKDRSFPPKFNNYTHFLSYVKTAPGDERPSSSRARNVCFGWMHFSVNDYDVLAGGYNTISNKIITQIPAVKARHLPLPSFVMPGPGHTGGNLVVLSTQIEFQCIVLNPVSYKIRMRYVAYSPNRSINLTVSIRSEIGNYQNIVPNISSTVQSPEDTKNPKYEHFQYLDISIPLELFGITNITITRSDSISNNTLIIDKIEFTPDV

SEQ ID NO: 424 - protein, 699 aa, Bacillus thuringiensis S2160-1
MNHNNNNNKYEIIDSHASPYPSNKNSNHSRYPYTNNTNYKDWLNICQQNQQYDEGFETFESADTIAAVSAGIIVAGTMLSAFTSPLGPALIISFGTLLPIFWKPGEDPKTVWKAFVKIGYRPFGLPVDEAIVNLLYNKVDALKTQFEDYQRYFDIWKANPTSQNADAVKNKFLTLDTLVIGTLQELKKDYAIILLPGYTQIANWHLNLLRQAADNYDKWAPSSNLSIQSIYPQDYISDLNTCLTNCSTESNNKVSSKYYKCILKCRTAEYINHCSEKYQDGLNQLKNSSNINWDIYNAYRREMTFTVLDHIAIFPNYDPEKYPTGTHSELTREIYTDAVMRRYETGSPIPIAQREQELTRTPHLFSRLNKFTLFTAKNILPGLHAVQNHFSYTNDSTVRLSPIYKPENLSEPNTDNPPPFDISNTAVRSIAVKRRYEYYHITAIDFDTIDGNPRRYNSGYTPENLGIDYFIFTEFPAGKIPPYGLGTKYTHILSYIKISPRGNLSLPAERELSFAWTHTSVNFNNTISNTITTQIPAVKAKSLDPSSSVISGPGHTGGDLVSLRSSMQIMCYVPTAARYQIRMRCVAYSPNRSINLTLNIAGVTNYSLRALGIGSIKNIINPKYDDFQYIYFQTEDPQQVATVNLSSNFTMFLNSSDFADNTILIDKFEFIPITNTLEENLETQKLEKIQQTVNTLFTN

SEQ ID NO: 425 - protein, 362 aa, YBacillus thuringiensis 1518
MNKKSITHEEFIRQLKEYNLDNNLNYHDPAVLKKINELLPADQQYDLISPTQDWYQFKTLYPISKNGVIISSNLDDSSNVLVPELSENPYDPIPQSGKSTIQTAVRSPEALYIILTTNNSLSFGGGTNTMIATRIALLSVTRPELYQAITKVNYVYKSGQTAPRNAPVAYIELSPNNSYVQTLLNDSHMKRTSSYELVGSSIARRGIETKWSKSHTSGVSDTDSWSLAVSAGIDIEWDVGIPLTASAKEKLSLSITGTYGQSTTVSSQDTITQEYTFAKPGKDYKYDDYAYAVYQLKSNYQFIAGDAFNNLINSLSFGNQFSVHGDASYQYSTDTIFSTQTPDPTPTNEKSLIQVNFNPRFS

SEQ ID NO: 426 - protein, 663 aa, Bacillus thuringiensis Ywc2-8
MNSYQNKNEYEISDASRNNSNMSTRYPRYPLANNPQMPMRNTNYKEWLAMCADNKDNEQVPISPLDQEWRTVLPILFSAAASLTGLISLPTFGAISAGAAIAAALTSILFPSQGPDVFNELMGATENLLKREIETYVRGRAASELLALEDQRAYFKSAFDYWRLHPTDGNAIATVAARFHTVNGAFVTAMRLFRPAGYEALLLPVYAQAARLHLLHLRDGVLFANEWGLAKPDPGDLHDQEFNAKAAEYADYCELTYNTELNRIKTTSGKTWFDYNQYRRLMTFAVLDVVAKFSILNPRIYSLALQGEILTRKIYTDPVNFSPGSSIADDENRYTVPPSHVRQLVNSRLFTNVASVQNAGFIGNQNRYKNIGVSDLVDGPIIGQSVFEKVDADIPTNVSVFEVGVNGIQNDYPRNIGLKKTPSNAFTNNYAGSTNNLGPFTTVSLPPKDDKPLDHTNFSHRLSDIILPGNKGSSFAWTHVDVDPTGNYLSTTKINLIPATKASKLPLSFQLRKGPGFIGGDLVRLGNGVGISYKFNFQSSDSSANFRIRIRYAGAGSGASGGGQVYFKLGNYQSPDTSWGHTGFDSNNVKYNQFKVLELLGTAGNITANDLEIIVWTRDPGASDFYLDRLELIPMTGISTEYNEPQKLETAKKAVNDLFTNNL

SEQ ID NO: 427 - protein, 663 aa, Bacillus thuringiensis G7-1
MNSYQNKNEYEILDASRNNSNMSTRYPRYPLANNPQMPMRNTNYKEWLAMCADNKNNEQVPISPLDQEWRTVLPILFSAAASLTGLISLPTFGAISAGAAIAAALTSILFPSQGPDVFNELMGATENLLKREIETYVRGRAASELLALEDQRAYFKSAFDYWRLHPTDGNAIATVAARFHTVNGAFVTAMRLFRPAGYEALLLPVYAQAARLHLLHLRDGVLFANEWGLAKPDPGDLHDQEFNAKAAEYADYCELTYNTELNRIKTTSGKTWFDYNQYRRLMTFAVLDVVAKFSILNPRIYSLALQGEILTRKIYTDPVNFSPGSSIADDENRYTVPPSHVRQLVNSRLFTNVASVQNAGFIGNQNRYKNIGVSDLVDGPIIGQSVFEKVDADIPTNVSVFEVGVNGIQNDYPRNIGLKKTPSNAFTNNYAGSTNNLGPFTTVSLPPKDDKPLDHTNFSHRLSDIILPGNKGSSFAWTHVDVDPTGNYLSTTKINLIPATKASKLPLSFQLRKGPGFIGGDLVRLGNGVGISYKFNFQSSDSSANFRIRIRYAGAGSGASGGGQVYFKLGNYQSPDTSWGHTGFDSNNVKYNQFKVLELLGTAGNITANDLEIIVWTRDPGASDFYLDRLELIPMTGISTEYNEPQKLETAKKAVNDLFTNNL

SEQ ID NO: 428 - protein, 665 aa, Bacillus thuringiensis kim LBIT-980
MNSYQKKNDYEILNASPSYFNTLDSYPRYPLANDPQASMQTRNYKDWQNECEGITPSGFGAFSFIISIIIQFQSFLSEPSLSGGLGIGLDIADSLIADDVSQLSAREVRDLIQSGLTDLAISIASGSFNDIVEKYRDYLEVFKRWESGGRTDDDTRETIGRLIMDAERAAAELNQFSHGDYKIPLLPTYAQAANLHLKILRDILIHGEDLQIISTADRQFYRDKLFGGLKNYTNYCVDQYNAGLNQIKEAGTSAANWLRFHRFRREMTLSVLDLIALFPTYDIDSYDLPVNVELSRIIYTDPVGWTVEGMSTIYPWYSPYNRLAFNQLEAETIRGPYLSTWLDYIDIYSSQYSSLKVWSGNANTMKTIGGETRRQDGSAVGTPQRITVGNTDIFKVELTAGVHHFLIDYTNPNPLRSYGIINSKFFMTNGSTPTYTGSVGSMHTQTGKVAALPGVESEVPTANDYTHRLSDVINLTGGLPQHGSNSVRSSLVAHGWTHKSLKRENIIEANQISQIPAVKSYSMSGGLTVRHVSDHTGGDVVYFAQVGRVKILCKFTSPGYYKMRIRYASDYSATMTVNGIPVSLSSTTQVRSNLPYEAFQYAQVGPNHVFAVLTPKTLEFDIYGGVNGFMIDKIEFIPSNITTLEYEEERDLEKTKNAVNDLFIN

SEQ ID NO: 429 - protein, 1385 aa, Bacillus thuringiensis darmstadiensis PS17
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKQKYIEIMTTHCLDFARLFPTFDPDLYPTGSGDISLQKTRRILSPFIPIRTADGLTLNNTSIDTSNWPNYENGNGAFPNPKERILKQFKLYPSWRAGQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTSGEYQIRCRYASNDNTNVFFNVDTGGANPIFQQINFASTVDNNTGVQGANGVYVVKSIATTDNSFTEIPAKTINVHLTNQGSSDVFLDRIEFIPFSLPLIYHGSYNTSSGADDVLWSSSNMNYYDIIVNGQANSSSIASSMHLLNKGKVIKTIDIPGHSETFFATFPVPEGFNEVRILAGLPEVSGNITVQSNNPPQPSNNGGGDGGGNGGGDGGQYNFSLSGSDHTTIYHGKLETGIHVQGNYTYTGTPVLILNAYRNNTVVSSIPVYSPFDITIQTEADSLELELQPRYGFATVNGTATVKSPNVNYDRSFKLPIDLQNITTQVNALFASGTQNMLAHNVSDHDIEEVVLKVDALSDEVFGDEKKALRKLVNQAKRLSRARNLLIGGSFENWDAWYKGRNVVTVSDHELFKSDHVLLPPPGLSPSYIFQKVEESKLKPNTRYIVSGFIAHGKDLEIVVSRYGQEVQKVVQVPYGEAFPLTSNGPVCCPPRSTSNGTLGDPHFFSYSIDVGALDLQANPGIEFGLRIVNPTGMARVSNLEIREDRPLAANEIRQVQRVARNWRTEYEKERAEVTSLIQPVINRINGLYENGNWNGSIRSDISYQNIDAIVLPTLPKLRHWFMSDRFSEQGDIMAKFQGALNRAYAQLEQSTLLHNGHFTKDAANWTIEGDAHQITLEDGRRVLRLPDWSSSVSQMIEIENFNPDKEYNLVFHGQGEGTVTLEHGEETKYIETHTHHFANFTTSQRQGLTFESNKVTVTISSEDGEFLVDNIALVEAPLPTDDQNSEGNTASSTNSDTSMNNNQ

SEQ ID NO: 430 - protein, 1289 aa, Bacillus thuringiensis darmstadiensis PS17
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKQKYIEIMTTHCLDFARLFPTFDPDLYPTGSGDISLQKTRRILSPFIPIRTADGLTLNNTSIDTSNWPNYENGNGAFPNPKERILKQFKLYPSWRAAQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTSGEYQIRCRYASNDNTNVFFNVDTGGANPIFQQINFASTVDNNTGVQGANGVYVVKSIATTDNSFTVKIPAKTINVHLTNQGSSDVFLDRIEFVPILESNTVTIFNNSYTTGSANLIPAIAPLWSTSSDKALTGSMSITGRTTPNSDDALLRFFKTNYDTQTIPIPGSGKDFTNTLEIQDIVSIDIFVGSGLHGSDGSIKLDFTNNNSGSGGSPKSFTEQNDLENITTQVNALFTSNTQDALATDVSDHDIEEVVLKVDALSDEVFGKEKKTLRKFVNQAKRLSKARNLLVGGNFDNLDAWYRGRNVVNVSNHELLKSDHVLLPPPGLSPSYIFQKVEESKLKRNTRYTVSGFIAHATDLEIVVSRYGQEIKKVVQVPYGEAFPLTSSGPVCCIPHSTSNGTLGNPHFFSYSIDVGALDVDTNPGIEFGLRIVNPTGMARVSNLEIREDRPLAANEIRQVQRVARNWRTEYEKERAEVTSLIQPVINRINGLYDNGNWNGSIRSDISYQNIDAIVLPTLPKLRHWFMSDRFSEQGDIMAKFQGALNRAYAQLEQNTLLHNGHFTKDAANWTVEGDAHQVVLEDGKRVLRLPDWSSSVSQTIEIENFDPDKEYQLVFHGQGEGTVTLEHGEETKYIETHTHHFANFTTSQRQGLTFESNKVTVTISSEDGEFLVDNIALVEAPLPTDDQNSEGNTASSTNSDTSMNNNQ

SEQ ID NO: 431 - protein, 931 aa, Bacillus thuringiensis L366
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKQKYIEIMTTHCLDFARLFPTFDPDLYPTGSGDISLQKTRRILSPFIPIRTADGLTLNNTSIDTSNWPNYENGNGAFPNPKERISKQFKLYPSWRAGQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTKQNYQVRCRYASNSDNPVFFNVDTGGANPIFQQINFESTVDSNMGVKGENGVYVVKSIATTDNSFTVKIPAKTINVHLTNQGSSDIFLDRIEFIPFKLTLSPTPITLDPMKTITASVLSATRASDGITTINDPVDGTLLSLPMGTSIDFSILNPTQTGTYQVSILYKSSSGGFTITKVTNDQNGQMVDYASTSELQYSNPIYVLSSNTGNTVLTIGPGGYSGPDLLIKEIRFTPATPNSSNKIDTDFQLVDGQGTVTIWKSDKIAYTLADIDIQISFNQTAWQSPNITPYLNDDPVGGIATFYNTTGESQHFTKDSLLFQRGFNNIRVNNGFGGATISGHMKANVIDNPS

SEQ ID NO: 432 - protein, 1245 aa, Bacillus thuringiensis PS86Q3
MATINELYPVPYNVLAHPIKEVDDPYSWSNLLKGIQEGWEEWGKTGQKKLFEDHLTIAWNLYKTGKLDYFALTKASISLIGFIPGAEAAVPFINMFVDFVWPKLFGANTEGKDQQLFNAIMDAVNKMVDNKFLSYNLSTLNKTIEGLQGNLGLFQNAIQVAICQGSTPERVNFDQNCTPCNPNQPCKDDLDRVASRFDTANSQFTQHLPEFKNPWSDENSTQEFKRTSVELTLPMYTTVATLHLLLYEGYIEFMTKWNFHNEQYLNNLKVELQQLIHSYSETVRTSFLQFLPTLNNRSKSSVNAYNRYVRNMTVNCLDIAATWPTFDTHNYHQGGKLDLTRIILSDTAGPIEEYTTGDKTSGPEHSNITPNNILDTPSPTYQHSFVSVDSIVYSRKELQQLDIATYSTNNSNNCHPYGLRLSYTDGSRYDYGDNQPDFTTSNNNYCHNSYTAPITLVNARHLYNAKGSLQNVESLVVSTVNGGSGSCICDAWINYLRPPQTSKNESRPDQKINVLYPITETVNKGTGGNLGVISAYVPMELVPENVIGDVNADTKLPLTQLKGFPFEKYGSEYNNRGISLVREWINGNNAVKLSNSQSVGIQITNQTKQKYEIRCRYASKGDNNVYFNVDLSENPFRNSISFGSTESSVVGVQGENGKYILKSITTVEIPAGSFYVHITNQGSSDLFLDRIEFVPKIQFQFCDNNNLHCDCNNPVDTDCTFCCVCTSLTDCDCNNPRGLDCTLCCQVENQLPSFVTLTDLQNITTQVNALVASSEHDTLATDVSDYEIEEVVLKVDALSGEVFGKEKKALRKLVNHTKRLSKARNLLIGGNFDNLDAWYRGRNVVNVSDHELFKSDHVLLPPPTLYSSYMFQKVEESKLKANTRYTVSGFIAHAEDLEIVVSRYGQEVKKVVQVPYGEAFPLTSRGAICCPPRSTSNGKPADPHFFSYSIDVGTLDVEANPGIELGLRIVERTGMARVSNLEIREDRPLKKNELRNVQRAARNWRTAYDQERAEVTALIQPVLNQINALYENEDWNGAIRSGVSYHDLEAIVLPTLPKLNHWFMSDMLGEQGSILAQFQEALDRAYTQLEESTILHNGHFTTDAANWTIEGDAHHAILEDGRRVLRLPDWSSSVSQTIEIENFDPDKEYQLVFHAQGEGTVSLQHGEEGEYVETHPHKSANFTTSHRQGVTFETNKVTVEITSEDGEFLVDHIALVEAPLPTDDQSSDGNTTSNTNSNTSMNNNQ

SEQ ID NO: 433 - protein, 1245 aa, YBacillus thuringiensis 1518
MATINELYPVPYNVLAHPIKEVDDPYSWSNLLKGIQEGWEEWGKTGQKKLFEDHLTIAWNLYKTGKLDYFALTKASISLIGFIPGAEAAVPFINMFVDFVWPKLFGANTEGKDQQLFNAIMDAVNKMVDNKFLSYNLSTLNKTIEGLQGNLGLFQNAIQVAICQGSTPERVIFDQNCTPCNPNQPCKDDLDRVASRFDTANSQFTQHLPEFKNPWSDENSTQEFKRTSVELTLPMYTTVATLHLLLYKGYIEFMTKWNFHNEQYLNNLKVELQQLIHSYSETVRTSFLQFLPTLNNRSKSSVNAYNRYVRNMTVNCLDIAATWPTFDTHNYHQGGKLDLTRIILSDTAGPIEEYTTGDKTSGPEHSNITPNNILDTPSPTYQHSFVSVDSIVYSRKELQQLDIATYSTNNSNNCHPYGLRLSYTDGSRYDYGDNQPDFTTSNNNYCHNSYTAPITLVNARHLYNAKGSLQNVESLVVSTVNGGSGSCICDAWINYLRPPQTSKNESRPDQKINVLYPITETVNKGTGGNLGVISAYVPMELVPENVIGDVNADTKLPLTQLKGFPFEKYGSEYNNRGISLVREWINGNNAVKLSNSQSVGIQITNQTKQKYEIRCRYASKGDNNVYFNVDLSENPFRNSISFGSTESSVVGVQGENGKYILKSITTVEIPAGSFYVHITNQGSSDLFLDRIEFVPKIQFQFCDNNNLHCDCNNPVDTDCTFCCVCTSLTDCDCNNPRGLDCTLCCQVENQLPSFVTLTDLQNITTQVNALVASSEHDTLATDVSDYEIEEVVLKVDALSGEVFGKEKKALRKLVNHTKRLSKARNLLIGGNFDNLDAWYRGRNVVNVSDHELFKSDHVLLPPPTLYSSYMFQKVEESKLKANTRYTVSGFIAHAEDLEIVVSRYGQEVKKVVQVPYGEAFPLTSRGAICCPPRSTCNGKPADPHFFSYSIDVGTLDVEANPGIELGLRIVERTGMARVSNLEIREDRPLKKNELRNVQRAARNWRTAYDQERAEVTALIQPVLNQINALYENEDWNRAIRSGVSYHDLEAIVLPTLPKLNHWFMSDMLGEQGSILAQFQEALDRAYTQLEESTILHNGHFTTDAANWTIEGDAHHAILEDGRRVLRLPDWSSSVSQTIEIENFDPDKEYQLVFHAQGEGTVSLQHGEEGEYVETHPHKSANFTTSHRQGVTFETNKVTVEITSEDGEFLVDHIALVEAPLPTDDQSSDGNTTSNTNSNTSMNNNQ

SEQ ID NO: 434 - protein, 1245 aa, Bacillus thuringiensis zjfc85
MATINELYPVPYNVLAHPIKEVDDPYSWSNLLKGIQEGWEEWGKTGQKKLFEDHLTIAWNLYKTGKLDYFALTKASISLIGFIPGAEAAVPFINMFVDFVWPKLFGANTEGKDQQLFNAIMDAVNKMVDNKFLRYNLSTLNKTIEGLQGNLGLFQNPIQVAICQGSTPERVIFDQNCTPCNPNQPCKDDLDRVASRFDTANSQFTQHLPEFKNPWSDENSTQEFKRTSVELTLPLYTTVATLHLLLYKGYIEFMTKWNFHNAQYLNNLKVELQQLIHSYSETVRTSFLQFLPTLNNRSKSSVNAYNGYVRNMTVNCLDIAATWPTFDTHNYHQGRKLDLTRIILSDTAGPIKEYTTGDKTSGPQHSNITPNNILDTPSPTYQHSFVSVDSIVYSRKELQQLDIATYSTNNSNNCHPYGLRLSYTDGSRYDYGDNQPDFTTSNNNYCHNSYTAPITLVNARHLYNAKGSLQNVESLVVSTVNGGSGSCICDAWINYLRPPQTSKNESRPDQKINVLYPITETVNKGTGGNLGVISAYVPMELVPENVIGDVNADTKLPLTQLKGFPFEKYGSEYNNRGISLVREWINGNNAVKLSNSQSVGIQITNQTKQKYEIRCRYASKGDNNVYFNVDLSENPFRNSISFGSTESSVVGVQGENGKYILKSITTVEIPAGSFYVHITNQGSSDLFLDRIEFVPKIQFQFCDNNNLHCDCNNPVDTDCTFCCVCTSLTDCDCNNPRGLDCTLCCQVENQLPSFVTLTDLQNITTQVNALVASSEHDTLATDVSDYEIEEVVLKVDALSGEVFGKEKKALRKLVNHTKRLSKARNLLIGGNFDNLDAWYRGRNVVNVSDHELFKSDHVLLPPPTLYSSYMFQKVEESKLKANTRYTVSGFIAHAEDLEIVVSRYGQEVKKVVQVPYGEAFPLTSRGAICCPPRSTCNGKPADPHFFSYSIDVGTLDVEANPGIELGLRIVERTGMARVSNLEIREDRPLKKNELRNVQRAARNWRTAYDQERAEVTALIQPVLNQINALYENEDWNRAIRSGVSYHDLEAIVLPTLPKLNHWFMSDMLGEQGSILAQFQEALDRAYTQLEESTILHNGHFTTDAANWTIEGDAHHAILEDGRRVLRLPDWSSSVSQTIEIENFDPDKEYQLVFHAQGEGTVSLQHGEEGEYVETHPHKSANFTTSHRQGVTFETNKVTVEITSEDGEFLVDHIALVEAPLPTDDQSSDGNTTSNTNSNTSMNNNQ

SEQ ID NO: 435 - protein, 1327 aa, Bacillus thuringiensis T13001
MATLNNMFSVPYNVLALPIIPNSILTFEDNRKKIEEGIKEFEKTGRIKPLKDLIELIFKGYSDDESSYAALVQTMLVVIPLAFPELAPVLPIIGVVINFVFPGLKGSAKSTYTMITEMVDKAINQSFTAQITNILTNNITGIQNNIQSVYDAMSNAIGTNDTIHNFIRNNDTTPCSQNNQPACPCPPNNQCLQKVVDEYTKAIANIDLIIPQFHDPLTGVISDLATANMYILPLYAQTVNLKLILRQSFIEFMEKYKYDEKETVFQAFINADIPEQIKKLRQDIITYTKDIYMQFEAHAPYPTYNSKKQLNDYIRYTRIIQVYCLDLVAMWPTLDRVNYALPVQQNMTRIIFGDLIGPVETVPQVPRQNSDNFHFNLSDVYRNPLPNNDIFNYRYGGLQISKAQFMTYYKKFGAFSTHDEYYYVDGHRLSFNTSDKKTIEINAHQNSHDTIEKDVIDQLGGYVTRMNMVSQEIGSGSILGGNAIDRTALTTSTGDKDILAAGFNAINNGNYKTEGRGASHNQDVPNHKVQAIYPVQPNKYEYDDYGSEEKYGYLYTLIPMDVSFIPQLNAEDVITTIPAEQAVKINGQSVIDTVNTNSLLEFVNGANAIKLSPGETAQYTMINPVNRSYQVRVRVATEGETQLDIIAPVDSNTLNLSNTKTTANDQNGILGKQGNYIVFPQPNIDTVTGTSLPPTENIMNFPVGTFDFTIVNSGNSDTILDRIEFVPIVTSNKIQQDFTISPGTSQVIWTGNSANTIDITIIDNVDTSGLFVQIFQKGKQLHGELTLIDPAHIQRTFSEKFDQIVLYNPGYNSSISGTVSGSVSSIPKKFELSSDLQNITNQVNNLFASSEHDTLATDVSDYDIEEVILKVDALSDEVFGKEKKALRKLVNQAKRLSKARNLLLGGSFDNLDAWYRGRNVVTVSDHELFKSDHILLPLPTTLYPSYLFQKVEESKLKANTRYTVSGFIAHAEDLEIVVSRYGQEIKKVVQVPYGEAFPLTSSGPICCRPRSRVNGKPADPHFFSYSIDVGALDVEANPGIELGFRIVEPTGMARVSNLEIREDRPLTANEIRKVQRAARDWKQKYDQERAEVRALIQPVLNQINALYENEDWNGAIRSGVSYHDLEAIVLPTLPKLNHWFMSDMLGEQGSILAQFQEALNRAYTQLEGSTILHNGHFTTDAANWTIEGDAHQVVLEDGRRVLRLPDWSSSLSQTIEIENFDPDKEYQLVFHGQGEGTVTLEHGEEGEYVETHPHKFANFTTSQRQGITFESNKVTVTISSEDGEFLADNIAIVEVPMFNKNQMVNENRGVNINSNTNMNSSNNSNNQ

SEQ ID NO: 436 - protein, 1179 aa, Bacillus thuringiensis T13001
MVTVNEIYPSYYNVLASPYVFESNTDSIEKAVDDFRKGLAKGDVTKQVVNIIESIKDGKFNYQTVITSILSLASMVLPEIGFFMPIIGLFFSALSGGGPSIDIGSIFKAIQPAIQQMIDKSLTEDNIKDMDTQATVLQTQLKAYQTQLKAYTSITNPGTTDISDLHRVLDNTIEQLNSNLAFFQKEGYKDIGLPYYCLFATLYFTLLSDKIKNGVKWGYNSQAIPSFQTTFDTDLASHTQYVLNTYFENMPKSDDPARDARDDGDDGDAKFENKKAKYIRGMTLSCLDYVSLWPTFSPRDYSQEVDVEQTRTIVASPNISYFAHNIAPPPYHSPLSRIKIYNIVDPLYYGLPIIGAEKWDQSGGYETEGKLNGVQTPSVTFPQNDPVIQTLPCVAGPAESIIGVIGGYTFNLKSGNQLSLLPDHVLPMPCSLVGGLVGDEEDVKFPDNHKLNYMIDAKTSGYSVTVFENLVPENIIGQPVDTDNGNTVLQIKGFPAEKGRIGNPDQGELHYVYEPGNGAAAIDLKPYQILELPFYNYTNGDYHVRIRYASKSDIPAYFSVNTPNGSQARGPITLPNTETQASAVPGMSGKYAFNEGATVTIPVVKDKDYCTVNIQNNSQEALFIDRIEFVPKTNLCDNLHCDCNNPVDTDCQMCCICASLTDCDCNNPHGFDCAICCSLGISHPSFVTLTDLQNITTQVNALFASETKNMLAKEVNDHDIEEVVLKVDALSDEVFGTEKKALRKLVNQAKRLSKARNLLVGGSFENWDAWYKGQKVIRLSDHELLKGDHVFLPSPTLYPSYIFQKVEESKLKPNTRYTVSGFIAHAIGLEIVVSRYGQEIKKVVQVPYGEAFPLTPIGRICCQSYSTSNGKPVDPHFFSYSIDVGALDVEANPGIEFGLRIVERTGMARVSNLEIREDRSLTANELRIVQRAARDWKTTYDQERAEVTALIQPVLNQINGLYENGDWNGVIRSGISYHDVESIVLPTLPKLRHWFISDMLSAQGNIIARFQEVLNFAHRQLEENTLLHNGHFTTDAANWTVEGDAHQRTLEDGRRVLRFPDWSSSVSQTIEIENFDPNKEYQLVFHGQGEGTVTLEHGEETKYIETHTHHFANFTTSQRQGLTFESNKVTVTISSEDGEFLVDNIALVEVPMFNKNQMVNENRGININSNTNMNSSNNQ

SEQ ID NO: 437 - protein, 869 aa, Bacillus thuringiensis T13001
MKNLEKGLTGQDATKAIANALQLIFIDDTVNYQSYVNFALSLITIAVPEIGILTPFIGLFFAALNKNSATPPSATDIFQAMQPAIQAMIDKSLETEELKHLNDAAAELRGALSAYQDEMDTIQGLGGFDKVDQATKDLFWGKLIDVDTFFRVKVPVFIQPNPQFPDLVLISAPYYTMFASMHLIFLRDIIYHGQTWNAKKFTQGVNGVSGSLDAYKIDLKKLIKTYSKNIHDIFNQGLQRYGDSFNDTVQFRKKQQYIEIMTTHCLDFARLFPTFDPDLYPIGSSGINLQKTRRLLSPILPIREFDVVSIDTSKWPDYNNGLLPDPNKRVLKKVTLYPYYGSRWDPNRNILWAVEIEDSFGTQLYGTIPPDSSSIDTGDKGGAHPIPIDPSNPVVDIYMYSFHTNGEATIQFTMKDGTQYKVGWVGSLQRYEIPGAHYLSYLYEVDYTKDDDPKYGYGRIGRLVGVSTPQEAMGENYIGIPDEDGNLSGMGFAWENGDIDNGIGSLQVVKETITGTNVVKLNYQQIVRLPIQNKTKLSYNVRIHYASKNEIKGFFHIYTGSDDLLKGEVTFPSTETDDVQKMVAVQGDNGKYALHVFETPVTLPVGQFTAYIQNNSTEDFYLDRIEFVPVTSDDNLPDITIPFHANLSIQPGESQTIWKSPGSRVGISTDFTTHVLSNFVGFAQYYKSGEPLDRSSMGDLSDHVQKSISTGFDEIRIMNAGEVGTASIVGTVSGSIDLSSNNNPGNNPNDTVTIDTSFDVSRGDTQIIWTAPQSKLGVSTKFQLDLGIYSTIELHYLKSGVIQQPIGVYSDDDQDNLIQDSVPTGFDQIEVYNSYDFYNHFDNAEGSLKGTISFASNSSRNTFVFLKNK

SEQ ID NO: 438 - protein, 303 aa, Bacillus thuringiensis jegathesan
MEITDIVLKIYDFIEWDYVTNQDGIPYTLFDKAIYEYELNDTVTIPETKVFKTTPIPIASALTITENRSSQTQLHTIKFSEKKMESVTNTTVHGFKIGGAIKVGAKGTVTANFLVSGGTAEANVELSLTGEYNYSSTTANVNQTEKTWEITENVSVASHTSLTSQLIIMQADIRVPMILNSNLIGKRYYDDYANMFFSYIFQSKTSGRTEMISPASRLANQSWPGKPIVFKSGGSNGSLNLSGFGYSDLYKGLYAFIRYTETPLDRYSSPGKTWDSNLIHLRDGQILNVYDNRGIVKPVRLVE

SEQ ID NO: 439 - protein, 303 aa, Bacillus thuringiensis israelensis
MEITDIVLKIYDFIEWDYVTNQDGIPYTLFDKAIYEYELNDTVTIPETKVFQTTPIPIASALTITENRSSQTQLHTIKFSEKKMESVTNTTVHGFKIGGAIKVGAKGTVTANFLVSGGTAEANVELSLTGEYNYSSTTANVNQTEKTWEITENVSVASHTSLTSQLIIMQADIRVPMILNSNLIGKRYYDDYANMFFSYIFQSKTSGRTEMISPASRLANQSWPGKPIVFKSGGSNGSLNLSGFGYSDLYKGLYAFIRYTETPLDRYSSPGKTWDSNLIHLRDGQILNVYDNRGIVKPVRLVE

SEQ ID NO: 440 - protein, 303 aa, Bacillus thuringiensis IBL 4222; identical to SEQ ID NO: 439

SEQ ID NO: 441 - protein, 319 aa, Bacillus thuringiensis malayensis
MTITNIELAIRDYTNWDGTREIPGYINRQVIDGPNIYDYVISDSVAVPKTVIFNVNPTPYTGPNIISENNTDVNQNKRIKFSEKVVETTTHTTTKGFKIGGGIKSTTKGTLKLKFPVGELGFEQTPELPPTGEYNSSSTTGNTCANEKLWEITDNITVPPHSRVTSTLIIMKTEVRVPMELTTNLRGTNSSGEGSFPTSNGLFSYTTSARGTVGGIFVSYYVRPASALYNTSWPDKPATFNSIGSNESLNLLGSGYSDVVPSLYVTIRQDQTPLSGYPGETKTWYSDKVILRDGRIVTLPSNADVNMSQTAKIPYCDRS

SEQ ID NO: 442 - protein, 319 aa, Bacillus thuringiensis israelensis
MTITNIELAIRDYTNWDGTREIPGYINRQVIDGPNIYDYVISDSVAVPKTVIFNVNPTPYTGPNIISENNTDVNQNKRIKFSEKVVETTTHTTTKGFKIGGGIKSTTKGTLKLKFPVGELGFEQTLELPLTGEYNSSSTTGNTCANEKLWEITDNITVPPHSRVTSTLIIMKTEVRVPMELTTNLRGTNSSGEGSFPTSNGLFSYTTSARGTVGGIFVSYYVRPASALYNTSWPDKPATFNSIGSNESLNLLGSGYSDVVPSLYVTIRQDQTPLSGYPGETKTWYSDKVILRDGRIVTLPSNADVNMSQTAKIPYCDRS

SEQ ID NO: 443 - protein, 319 aa, Bacillus thuringiensis IBL 4222; identical to SEQ ID NO: 442

SEQ ID NO: 444 - protein, 1154 aa, Bacillus thuringiensis serovar tochigiensis BGSC 4Y1
MKEQEFKGMDVLSNAQKTETLPCDLNITGCSPNNFLNISEEIDANLVPYNAPSAITTSIEITSTLLSDLGVPGASTIGLLLGKLINLLWPGGENDKSVWTSLLNESEELVNQKIEDITVITNAETALRGMHRVLQSYRSALNSWINPKGERISPEAMRTTYISALTTLNNSMASFSVPKHELPLLTLYSQAANIYLYVAKDITIFGKEWGFTYRNPEREGDIEFYYNEFLKYTAEHSEYCIDWYNQGLNQLSQSNSRDWVKYNKYRREMTIMVLDIISLFSSYDGFLYPQKTKTELTRMIFTNPIVYEGKQQYTWHQLAPSFSEIEDSAVPKPDYFRVLRNLLIHTKSYGSGVSATNYWSSHDLTYSLTNTPIYHQVSFGNKSTNGDDKYNNFSLSGRDVYKIISIARQNGPSYTDFIVNQFEMQTLNTSNAKNVLSYNHPSEWSNRQTFDSTTELPVTTNPPTTYGDDKQYSHRLGFISEVQHSSSRPNLIPIYGWTHTSVNLDNRIYSDRITQIPAIKSSPDLGGNFQNIAKGPGFNGGYVTTARSVNALVDVLKLQVTLDQNSLAQKYRVRLRYASNKRVPATLFTNTSGDYKFELQPSEVAPNPPYTKYQSFRYIDIPGLVSFTSTTDVVTVYLDMRYAPVGSYVEVDRIEFIPSNEIAELEKSLEKMKQAVNALFAEGRNVLKLDVTDRQIDMLSNLIDCLPEDVEPSEKRNLLNAVRYAKRLSQSRNLFIDSDFKLFNTGNGWSGSQSISISEGNILFKGPYLRLLGSNDDGSIPTYLYQKIDESKLKAYTRYKVRGFIGESKDLELYIVRYDGNTHTVMNVPRPRISPSIVMDSCGIPDRCKTHIEFDVSDTLSTDGSSSDPHAFSYHIDIGDMDLNENLGIWVIFKISTPDGYATLGNIECVEEGPLVGGALAQIKKKEQKFKEKIIEIRANTQRIYTEAKQAINNLFTDPPQDTKLKLATSLVKILEADGIAQRIPEIYNQWLYNIQGMNYSLFQELNTRIYQALELYTLRNLVQNPRFLDELSNWNVTSNVSVQQISGIPVLVLSNWDAQVKQRIVLKEDCGYILRVTAKKEGVGAGNVNISDCVGNAETLIFTSCNDKSTNISFNYDTQSIEFFPDAEQVYIEITESEGTFYIQNIELFLMRE

SEQ ID NO: 445 - protein, 753 aa, Bacillus thuringiensis MO19
MSVVYYVKGGDIMDPFSNCSEKKYSDSNNNQELTVESSSFYSNTTNENMKKNYPPINKNFSRNSNDTVLDILNISQNNNIDIFAPYNNLHSIKDELQIRTVIPGGVIFSVTGNKFVDSKFTAITYAAITKLTSSLITAAATAILGPIGTTIGGAISGPIANALFGLIPGMKPLTPQEIIDIAVEQSKLYTDEQITNLVITNATSELASIKAKIEDFNSQLNFALNSKNDNLMNRIDFETFLVTLENDIYGSIIKLMNFGYSKQLLPIITVCCTLNLSFLRDAIFNSQTFNISTQGKRVLTDTFERRTIEYSDKIINEYTLLFNEIKLKENAKTTLDFRTFMSLQVLDQVDLWSVFKFSQFNIRNTRRLYTIPYQYSENDVSKLDPTQINGDWKFINQILYGLPGNRISGFAGTVELYQPNKIRRINKLKALYSNNETTGYVGKDANAMDSFDTHPIISQKPAIINYASHVIVNLPPSSVQNLTLLDTIGPIFPGKYVINQQLYPGLNSLLEYEKFAIPDHKGVNVAGLPNIDSSYTSSTIDNLRQNFITSKPILGSVTAFQKDIPNYEQVNNKEQIVHLCPTDTDQKLLGFNIPALEYSKDRIANFGFEETWMIIPSYSSSGDNLQFKGTTAGIKYYLKSAQNAYANYKIFIKIAYKPNNSGNKVQLNINMKDLTSSSIISATLNIQNTSLLKGTSEDNVKFITFEVPTNFPISNNTYELQLIFTNLQQNDDLRLNELILHPINNDFINILNA

SEQ ID NO: 446 - protein, 305 aa, Bacillus thuringiensis tohokuensis
MAIFDVEADLIDNNKWYAQKYYNANPSTFRNPIVYDMNVSDLDVVPITTEFSSTPQLTNSATQVVRNNTSKDQSQTVLFSEKSIETFSRSTTEGYKIGSSIKSTTSFKVKVGFLVSGEINQSIEVAITGEYNHSSTETTTTTNEKLWQVTQPVIIPPYTQVTATLQIFSGPFVVPAKTKATIQGKGTNNGAYNFASAITYTDNSGRVYTDRNRAQALYTDRNEWPGYKRIYVGGSSSTDPTGLLRLEGEARITAQVGLYAVTEFRESPLPGYAGVGSNRTYYAPNILLGDGSVIQFPEYQRYLQR

SEQ ID NO: 447 - protein, 1060 aa, Bacillus thuringiensis serovar pakistani str. T13001
MADNNLQYTPPLRLDAEEYVPWKDVDSDVIIDAVAGAEGALFNLLIPGSGKIVEWGVSKFLKWATGDTYKPPSLSQEITRVEGMIATLQQQMYNVISATKAEILQNVAGLFFSNVVSAVNDYHHYLERWLDNSDDSNRLAELKSSLDKAIDEAHKAVSASYYNQNAQYTFAYNVNAATFSLILMRDKYLNYTQWGYGDAAGAQNFYEGTFLYRLKDYTTNILTQYNAILKLVHDLAVNPYSEPYREVTNRNPLQVTTNPLYNGKSDQRSMYWPSAYYGGSDNMRKKCISPMASDPYKHFSDSRIENQWNDDQHRSCQTPLPNGGLEMQINMPDQLKLSFQWNAYNRTRNVLTQTGLDFIAIWPYFDPIQYPPGEVTADLTRMLYSDLAGAITKNDIQSVDDIDNHVKKQSDLFEFLKSSKLYTKNVKVQTQQGPPFAYDSSTVKTHVDGDIIVGIENTTERTLETNTRNPGGIQGSSSDNADTIDPTEASKSVSISQWLFPRIFNFNGKVIGSVNETTPGNVTGIYNNLTYDFTLPEHQISWLSYVQAQENVLRPTNGYDYLTGNLTAANQGQIGALAIGWTKANIDANNTVKKGTITSIPAVKSHSITDWGTGTVVKGPGHTGGDLVKLPPNTRAKMIVTIEDTSTSYDVRIRYAAPSGGHIQFSYWNGGSDVKVADTQLQNTGGNTNFEHFQYAMLTTDNAKFKAPFSPVEILIENIGDSDVYLDKVEFSVLGQLPPGATPLTSQYMNPYGYNILWQSKNGEAANQGMVTFSQNDSAIKTFYLYNTEVVHQTTGSPSRWNGKFDTLYVQSPTSINLTQGFIVIDTTKNNPEPPIALPNQDILRPFTNEHEIWNGRYSTKALNLSLSTSSGAEGKIKFYNNTNLVHESPALSGSPSEPYTWEGSFNRITVYQSNSSDSNYFNLFGGFLKLDPNSNDNGNNGGPHNDCENIAHPDQPLYYESNNLIWTAAPNKLAYSTTEMQFVLSGGLGFTPGDIGAKIKLNFWKNDSIQYVAYGAVANLDFISAPAQSIPGGFDKITMDNDEYSFSTSLRMTLGSVCY

SEQ ID NO: 448 - protein, 781 aa, Bacillus thuringiensis serovar andalousiensis BGSC 4AW1
MKNGGLQMSRNDSNNDLPMSVLSRSQSKYLMTNMPLSELIHLSEQEWLDMYRKWKPMSTLDIDAEIGVTAALGIISFILSVSNPVSAAAVGIASILVPILWPTPAASPDPDIVWKSMIKNVENLIDEKIAQLHYDLAFAKLNGLKAGMVEFNQAIENLNQNPSSSGLKEAVRTKYRSLDSLFTYSMPQFAVNTAEIQLLPVYVEAATLHLLHKRTGFNFGKSWDLDPIEVESLYNDLIRLTGTYTDHCIRWYNRGLENLNPSTNTINYKPANMRDCNKYPWVKYDQSEWYYVNPSPNMCTTALSENSCKESMNVYNTEATPRWYGYRASQGEYQGLENWNSYNAFRRNLTTLVLDIIAVWPTFDPKLYKYGIKAELTRKLYSDICGTTYRSDPSQNSVNAIESKIVSPPSFFEWLDQIDFHTIVRDQGPNVGDFTSGELLTGVQQTVRRTLANPSLKPLEGKAGEQPTKIVRLTPNTFDITEVSTKQWFEPREIVLKRAGTNILTVGTITDERPYWSSLDRGLIYPKVKIYDQTQKNNQIPKTADPNKPQSEWDYSHRLSWFWYYPIREDAPMTYPNDKQIGAMACVWTHMSVDPTNSIAPDKITQIPAVKGNGMYFGGEIIKGLDNTGGDLVKLYSTSDRNQLQVDLKIPARMNNISGYQIRIRYASKQSGDIYLELERSVNSQWRLSTIPPTYSGNNLTSNSFGYHDALVIASQENAHPATLRIRNNDSPSLNTEIIIDKIEFIPIEGSLEEYEAKQKLEKAREVVNILFDSGANFEKA

SEQ ID NO: 449 - protein, 1078 aa, Bacillus thuringiensis serovar tochigiensis BGSC 4Y1
MSDKKGDKCMKQKRNAMKNKINAQSSPWFPANHKNKVEILQKGMNGVFDKKLGLNISPFPKVLTTCMQIVLKSIQFKSTLDIQIKEIFNCLWPMNADSQFIWQLCIAHLESLIQFDMPKSLKHNIFKRLQNIENEMKVYEKSFDEWQRTSNENVKKQELKKIIFNIESFLEECIRFFAMEKYELLLLVIYAQIANLHLLILRISLIYGEELDLTQEEQSVYQNKLISKIKLYTNYCTHQYKRGLFRIKKMQDYSCNSIEKWNLFNAYQKDMTLMVLDIISIWPTYDYSRYPMKTKIELTREIWTDIQYVSIENDKANLNKEVDFTLCTEPQIFEWLSTLEFYMRNSSNTSEFMGNIVGIHYSSYKTHHRKQHISRWWGEKSKYDYKLTVQNLQEYPVYNSIAQNSYESNQKVIKYIEKESQLLYHRLSRISGVIECPDKTNVSAITFAWAHVSVQETHDIDNKKLIIQIPASKAWSDETGKLRVIDGISTGGPLVLLEDTPLTISLNSKILHHLRIRYACNNNGVLRISKKPKLGSLSECIAEQAYKTTYEGSERDLVFESFDYLDFDFLLGETTSPYLIILERIQGTSPLIIDKIECIPVCITKRQHENNQYIKEAQKAVNQLFTNSLKNKLKFETTDYNVDQTAKKVESIYDSISLKEKVSLLRDVKHAKRLSKYRNLISNEDFGLPELISKNSWQFTHHVRVSCSDPQFKGYFLEIPSVKNVSLNEKDLFRNVYQKIDESKLKPYTRYIVRGFIGHCEDLEIWVTRYEKEVMSLQNVNNIVNNNGSVSHDTSHYFKVHIDVGNLDIEENLGIWVAFQITSPNGSATLGNIELIEMMPLSGKLLTQIKNTEEEWKKEKERRQLESNKSIQIANKAVKGLFDSSQEKKLNIVTSKKDILDALEKVENITYVYHSYLHNVVGNNFNVYKQLQERINRAFDLYQSRNKIMNGDFSRKDLGWNITPGIEFLKEEYRYFSLFIKHWSSSAVQEIELKSTCEYLLRVTGTKKAAGTGYVVCSGCASEYIQALFFTASEGERITKTIEVFPKTNRVQIEISTTNGTFLVESIELICLEDEKID

SEQ ID NO: 450 - protein, 475 aa, Bacillus thuringiensis PS52A1
MIIDSKTTLPRHSLIHTIKLNSNKKYGPGDMTNGNQFIISKQEWATIGAYIQTGLGLPVNEQQLRTHVNLSQDISIPSDFSQLYDVYCSDKTSAEWWNKNLYPLIIKSANDIASYGFKVAGDPSIKKDGYFKKLQDELDNIVDNNSDDDAIAKAIKDFKARCGILIKEAKQYEEAAKNIVTSLDQFLHGDQKKLEGVINIQKRLKEVQTALNQAHGESSPAHKELLEKVKNLKTTLERTIKAEQDLEKKVEYSFLLGPLLGFVVYEILENTAVQHIKNQIDEIKKQLDSAQHDLDRDVKIIGMLNSINTDIDNLYSQGQEAIKVFQKLQGIWATIGAQIENLRTTSLQEVQDSDDADEIQIELEDASDAWLVVAQEARDFTLNAYSTNSRQNLPINVISDSCNCSTTNMTSNQYSNPTTNMTSNQYMISHEYTSLPNNFMLSRNSNLEYKCPENNFMIYWYNNSDWYNNSDWYNN

SEQ ID NO: 451 - protein, 475 aa, Bacillus thuringiensis YBT-1518; identical to SEQ ID NO: 450

SEQ ID NO: 452 - protein, 475 aa, Bacillus thuringiensis 96418
MIIDSKTTLPRHSLIHTIKLNSNKKYGPGDMTNGNQFIISKQEWATIGAYIQTGLGLPVNEQQLRTHVNLSQDISIPSDFSQLYDVYCSDKTSAEWWNKNLYPLIIKSANDIASYGFKVAGDPSIKKDGYFKKLQDELDNIVDNNSDDDAIAKAIKDFKARCGILIKEAKQYEEAAKNIVTSLDQFLHGDQKKLEGVINIQKRLKEVQTALNQAHGESSPAHKELLEKVKNLKTTLERTIKAEQDLEKKVEYSFLLGPLLGFVVYEILENTAVQHIKNQIDEIKKQLDSAQHDLDRDVKIIGMLNSINTDIDNLYSQGQEAIKVFQKLQGIWATIGAQIENLRTTSLQEVQDSDDADEIQIELEDASDAWLVVAQEARDFTLNAYSTNSRQNLPINVISDSCNCSTTNMTSNQYSNPTTNMTSNQYMISHEYTSLPNNFMLSRNSNLEYKCPESNFMIYWYNNSDWYNNSDWYNN

SEQ ID NO: 453 - protein, 395 aa, Bacillus thuringiensis PS69D1
MILGNGKTLPKHIRLAHIFATQNSSAKKDNPLGPEGMVTKDGFIISKEEWAFVQAYVTTGTGLPINDDEMRRHVGLPSRIQIPDDFNQLYKVYNEDKHLCSWWNGFLFPLVLKTANDISAYGFKCAGKGATKGYYEVMQDDVENISDNGYDKVAQEKAHKDLQARCKILIKEADQYKAAADDVSKHLNTFLKGGQDSDGNDVIGVEAVQVQLAQVKDNLDGLYGDKSPRHEELLKKVDDLKKELEAAIKAENELEKKVKMSFALGPLLGFVVYEILELTAVKSIHKKVEALQAELDTANDELDRDVKILGMMNSIDTDIDNMLEQGEQALVVFRKIAGIWSVISLNIGNLRETSLKEIEEENDDDALYIELGDAAGQWKEIAEEAQSFVLNAYTP

SEQ ID NO: 454 - protein, 808 aa, Bacillus thuringiensis MC28
MTKKHKKILSMTLATGVFAGTYIPTAYTAFAETEPKEDLNEKKTKNINQNNPSIDLKGWFENPYKGVTFDQFINAFNNNAWNPLLVDIKNNGNAGSGTLVFLKGMMGTGLSLLPPPASLLGSIWTIFMPSTNGGTDMWRQLETYIDEKIDSKINDYHKYLMGAEFNGAMSAIKEYQRVLQIYNDSKNSLKRVEAPGTGVITAARNADTALKAFISIIQTPEKETDSVYQQITAPIFVQAANAHLLLQRDMILYGEEWGMDKNQWQGYKDNQKKLIQEYTNYAMKVYNDGLEKKKKEAENINTQQPNRNTDKWNHINAYVREYTLSVLDFVDLFPATNPETYSKGIMQENSRQIYSSIKGAVIPQGGTGEGTTWENIQKILDSQEYKGDLHKLDIRSYDRIDAIQPWYSDKKNGGANWTTPGWTGNTNGGNLNPLINPLNNPITRVKAQSSRTPNYIDFKFDTGGNNPSFGRYVSGHASYKEDIFEYPNQKLSQVHAFNTSTYPGFQGIDAVVFGFVDKNLTQSSTYLMTNMITAIPAAKYNRGMSNFQPQVESIHAKQKAMKTDTTNSYLAYGVEVSKEQEYKIRYKVAANENSKISLSHRKPGGNYAKIDDTTIPITRNFADTVKGEYGSYKIVEGPTVKLTKGTHDLKLENSQGKFSVDQIELEPVEQDQVIAQDNFDDKRLSWVNLGGIVNGGVTGKAGMIDANGNTWSYIQDQVLPFSKYTLSIKVKLNSNNGNERQKVTLYTDNLKHERITKTVELKGNAGYQEIQLEFITRKDSANTHVGILTSNGASNILFDDVKVIGAKK

SEQ ID NO: 455 - protein, 815 aa, Bacillus cereus AH603
MGTGDFMTKKQKKILSITLATGVFAGTYIPTAYTAFAENEKKEDLQENQTKNINQNSLPIDSYGWFENPYKGVTFSQFIDAFNNNQWQPLLVNIKNKGDAGSGTISFLKGMMTTGLSLLPPPASLLASIWSVFIPTNDANGTDMWRQLEIYIDEKIDSKINDYHKYLMGAEFNGAMSAIKEYQRVLQIYNDSKNSLKRVEEPGTPVIEAVRAADRKLKEFIAVVQTPEKSNDSVYQQITAPIFVQAANAHLLLQRDMILYGEEWGMDKDQWQGYKDNQKKLIQEYTNYAMKVYNDGLEKRKKEAEEINTQQPNRNTDRWNHINDYVREYTLSVLDFVDLFPATNPETYSKGVMQENSRQIYSSIKGAVIPQGGTGEGTTWENIQKILDSQEYKGDLHKLDIRSFDRIDAIQPWFSDKQNGGSNWTTPGWTGNASGGALKNLINPSDNPITRVKAQSSRTPNYIDFKFDTGGDNPYFGRYFSGGSYKEDIFEYPNQKLSQIHAFNRSTYPGFEGIDAVVFGFVDKNLTQSSTYLMTNMITTIPAAKYNRGMSNFQPQVESIHAKQKAMKTDTTNSYLAYGVEISKEQEYKIRYKVAANENSKISLSHRKPGGNYAKIDDTTIPITGNAADTVKGEYGSYKIVEGPIVKLTKGAHDLKLENSQGKFSLDQIELEPVERDQVIARDNFDDQRLNWINLGGIVNGGITGKAGMIGTNGDTWTYIQDQVLPFSKYTLSIKVKLDSSDGNERQKVTIFTDNLKHERITKTVELKGKAGYQEMQLEFITSRDLANTHVGILTSNGTSNVLFDDVQVIGAKKS

SEQ ID NO: 456 - protein, 1138 aa, Bacillus thuringiensis galleriae PGSI245
MNLNNLDGYEDSNRTLNNSLNYPTQKALSPSLKNMNYQDFLSITEREQPEALASGNTAINTVVSVTGATLSALGVPGASFITNFYLKIAGLLWPENGKIWDEFMTEVEALIDQKIEEYVRNKAIAELDGLGSALDKYQKALADWLGKQDDPEAILSVATEFRIIDSLFEFSMPSFKVTGYEIPLLTVYAQAANLHLALLRDSTLYGDKWGFTQNNIEENYNRQKKRISEYSDHCTKWYNSGLSRLNGSTYEQWINYNRFRREMILMALDLVAVFPFHDPRRYSMETSTQLTREVYTDPVSLSISNPDIGPSFSQMENTAIRTPHLVDYLDELYIYTSKYKAFSHEIQPDLFYWSAHKVSFKKSEQSNLYTTGIYGKTSGYISSGAYSFHGNDIYRTLAAPSVVVYPYTQNYGVEQVEFYGVKGHVHYRGDNKYDLTYDSIDQLPPDGEPIHEKYTHRLCHATAIFKSTPDYDNATIPIFSWTHRSAEYYNRIYPNKITKIPAVKMYKLDDPSTVVKGPGFTGGDLVKRGSTGYIGDIKATVNSPLSQKYRVRVRYATNVSGQFNVYINDKITLQTKFQNTVETIGEGKDLTYGSFGYIEYSTTIQFPDEHPKITLHLSDLSNNSSFYVDSIEFIPVDVNYAEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSPECSSMQDGILSDSHSFSLNIDTGSINHNENLGIWVLFKISTLEGYAKFGNLEVIEDGPVIGEALARVKRQETKWRNKLAQLTTETQAIYTRAKQALDNLFANAQDSHLKRDVTFAEIAAARKIVQSIREAYMSWLSVVPGVNHPIFTELSGRVQRAFQLYDVRNVVRNGRFLNGLSDWIVTSDVKVQEENGNNVLVLNNWDAQVLQNVKLYQDRGYILHVTARKIGIGEGYITITDEEGHTDQLRFTACEEIDASNAFISGYITKELEFFPDTEKVHIEIGETEGIFLVESIELFLMEELC

SEQ ID NO: 457 - protein, 1138 aa, Bacillus thuringiensis dakota HD511
MNLNNLGGYEDSNRTLNNSLNYPTQKALSPSLKNMNYQDFLSITEREQPEALASGNTAINTVVSVTGATLSALGVPGASFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAFRTPHLVDYLDELYIYTSKYKAFSHEIQPDLFYWCVHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKIKKIPAVKMYKLDDLSTVVKGPGFTGGDLVKRGSNGYIGDIKATVNSPLSQKYRVRVRYATSVSGLFNVFINDEIALQKNFQSTVETIGEGKDLTYGSFGYIEYSTTIQFPNEHPKITLHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYSRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREVYMSWLSVVPGVNHPIFTELSGRVQRAFQLYDVRNVVRNGRFLNGLSDWIVTSDVNVQEENGNNVLVLNNWDAQVLRNVKLYQDRGYVLRVTARKIGIGEGYITITDEEGHTDQLRFTACEEIDASNAFISGYITKELEFFPDTEKVHIEIGETEGIFLVESIELFLMEELC

SEQ ID NO: 458 - protein, 1138 aa, Bacillus thuringiensis kumamotoensis 867
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWEFTQNNIEENYNRQKKHISEYSNHCVKWYNSGLSRLNGSTYEQWINYNRFRREMILMVLDIAAVFPIYDPRMYSMETSTQLTREVYTDPISLSISNPGIGPSFSQMENTAIRTPHLVDYLDELYIYTSKYKAFSHEIQPDLFYWSAHKVSFKQSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLGDTSTVVKGPGFTGGDLVKRGSNGYIGDIKATVNSPLSQNYRVRVRYATNVSGQFNVYINDKITLQRKFQNTVETIGEGKDLTYGSFGYIEYSTTIQFPDKHPKITLHLSDLSNNSSFYVDSIEFIPVDVNYDEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDIGSINHNENLGIWVLFKISTLEGYAKFGNLEVIEDGPVIGEALARVKRQETKWRNKLAQLTTETQAIYTRAKQALDNLFANAQDSHLKIDVTFAEIAAARKIVQSIREAYMSWLSVVPGVNHPIFTELSERVQRAFQLYDVRNVVRNGRFLNGLSDWIVTSDVKVQEENGNNVLVLNNWDAQVLQNVKLYQDRGYILRVTARKIGIGEGYITITDEEGHTVQLRFTACEVIDASNAFISGYITKELEFFPDTEKVHIEIGETEGIFLVESIELFLMEELC

SEQ ID NO: 459 - protein, 1138 aa, Bacillus thuringiensis WZ-9
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAIRTPHLVDYLDELYIYTSKYKAFSHEIQPDLFYWSAHKVSFKQSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLGDTSTVVKGPGFTGGDLVKRGSNGYIGDIKATVNSPLSQNYRVRVRYATNVSGQFNVYINDKITLQRKFQNTVETIGEGKDLTYGSFGYMEYSTTIQFPDEHPKITLHLSDLSNNSSFYVDSIEFIPVDVNYDEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDIGSINHNENLGIWVLFKISTLEGYAKFGNLEVIEDGPVIGEALARVKRQETKWRNKLAQLTTETQAIYTRAKQALDNLFANAQDSHLKIDVTFAEIAAARKIVQSIREAYMSWLSVVPGVNHPIFTELSERVQRAFQLYDVRNVVRNGRFLNGLSDWIVTSDVKVQEENGNNVLVLNNWDAQVLQNVKLYQDRGYILRVTARKIGIGEGYITITDEEGHTVQLRFTACEVIDASNAFISGYITKELEFFPDTEKVHIEIGETEGIFLVESIELFLMEELC

SEQ ID NO: 460 - protein, 1138 aa, Bacillus thuringiensis HQ122
MNLNNLDGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLHGSTYEQWINYNRFRREMILMVLDIAAVFPIYDPRMYSMETSTQLTREVYTDPISLSISNPDIGPSFSQMENTAIRTPHLVDYLDKLYIYTSKYKAFSHEIQPDLFYWSAHKVSFKQSEQSNLYTTGIYGKTSGYISSGEYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLDDLSTVVKGPGFTGGDLVKRGSNGYIGDIKATVNSPLSQKYRVRVRYATSVSGLFNVFINDEIALQRNFQSTVETIGEGKDLTYGSFGYIEYSTTIQFPNEHPKITLHLNHLSNNSPFYVDSIEFIPVDVNYDEKEKLEKAQKAVNTLFTEGRNALQKDVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSTNHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 461 - protein, 1145 aa, Bacillus thuringiensis monterrey GM-33
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWDEFMTEVETLIEQKIEQYARNKALAELEGLGNNLTIYQQALEDWLNNPDDPATIHDVIDRFRILDALFESYMPSFRVAGYEIPLLTVYAQAANLHLALLRDSTLYGDKWGFTQNNIEENYNRQKKHISEYSNHCVKWYNSGLSRLHGSTYEQWINYNRFRREMILMVLDIAAVFPIYDPRMYSMETSTQLTREVYTDPISLSISNPDIGPSFSQMENTAIRTPHLVDYLDKLYIYTSKYKAFSHEIQPDLFYWSAHKVSFKQSEQSNLYTTGIYGKTSGYISSGEYSFRGNDIYRTLAAPSVVVYPYTQNYGVEQVEFYGVKGHVHYRGDNKYDLTYDSIDQLPPDGESIHEKYTHRLCHATAISKSTPDYDNATIPIFSWTHRSAEYYNRIYPNKITKIPAVKMYKLDDLSTVVKGPGFTGGDLVKRGSNGYIGDIKATVNSPLSQKYRVRVRYATSVSGLFNVFINDEIALQRNFQSTVETIGEGKRFNLWFIWIYREYSTTIQYIRIEHPERITRSFKTHLSNNSPCYCRSIEFIPVDVNYAEKEKLEKAQKAVNALFTEGRNALQKHVTDYKVDQVSILVDCISGDLYPNEKRELQNLVKYAKRLSYSRNLLLDPTFDCINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSSSLNIDTGSINHNENLGIWVWFKIPTLEGYAKFGNLEVDEDGPVIGEALARVKRQETKWRNKLAQMTTETQAIYTRAKQALEYLFANAQDSHLKRNVTFAEIAAARKIVQSIREAYMSWLSVVPGVNHPIFTELSGRVQRAFQLYDVRNVVRNGRFLNGLSDWIVTSDVKVQEENGNNVLVLNNWDAQVLQNVKLYQDRGYILHVTARKIGIGEGYITITDEEGHTDQLRFTACEEIDASNAFISGYITKELEFFPDTEKVHIEIGGTEGIFLVEGILEVFLRLESYVI

SEQ ID NO: 462 - protein, 1138 aa, Bacillus thuringiensis HQ122
MNLNNLGGYEDSNRTLNNSLNYPTQKALSPSLKNMNYQDFLSITEREQPEALASGNTAINTVVSVTGATLSALGVPGASFITNFYLKITGLLWPHNKNIWDEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWGFTQNNIEENYNRQKKHISEYSNHCVKWYNSGLSRLNGSTYEQWINYNRFRREMILMVLDIAAVFPIYDPRMYSMETSTQLTREVYTDPISLSISNPDIGPSFSQMENTAIRTPHLVDYLDELYIYTSKYKAFSHEIQPDLFYWSAHKVSFKKSEQSNLYTTGIYGKTSGYISSGAYSFRGNDIYRTLAAPSVVVYPYTQNYGVEQVEFYGVKGHVHYRGDNKYDLTYDSIDQLPPDGEPIHEKYTHRLCHATAISKSTPDYDNATIPIFSWTHRSAEYYNRIYPNKITKIPAVKMYKLDDLSTVVKGPGFTGGDLVKRGSNGYIGDIKATVNSPLSQKYRVRVRYATSVFGLFNVFINDEIALQKNFQSTVETIGEGKDLTYGSFGYIEYSTTIQFPNEHPKITFHLNHLSNNSPFYVDSIEFIPVDVNYDEKEKLEKAQKAVNTLFTEGRNALQKYVTDYKVDQVSILVDCISGDLYPNEKRELQNLVKYAKRLSYSRNLLLDPTFDSINSSEENGWYGSNGIVIGNGDFVFKGNYLIFSGTNDTQYPTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 463 - protein, 1138 aa, Bacillus thuringiensis GW6; identical to SEQ ID NO: 459

SEQ ID NO: 464 - protein, 1138 aa, Bacillus thuringiensis; identical to SEQ ID NO: 459

SEQ ID NO: 465 - protein, 1138 aa, Bacillus thuringiensis QG-121
MNLNNLGGYEDSNRTLNNSLNYPTQKALSPSLKNMNYQDFLSITEREQPEALASGNTAINTVVSVTGATLSALGVPGASFITNFYLKITGLLWPHDKNIWHEFMTEVETLIEQKIEQYARNKALAELEGLGNNLTIYQQALEDWLNNPDDPATITRVIDRFRILDALFESYMPSFRVAGYEIPLLTVYAQAANLHLALLRDSTLYGDKWEFTQNNIEENYNRQKKHISEYSNHCVKWYNSGLSRLNGSTYEQWINYNRFRREMILMVLDIAAVFPIYDPRMYSMETSTQLTREVYTDPISLSISNPGIGPSFSQMENTAIRTPHLVDYLDELYIYTSKYKAFSHEIQPDLFYWSAHKVSFKQSEQSNLYTTGIYGKTSGYISSGAYSFRGNDIYRTLAAPSVVVYPYTQNYGVEQVEFYGVKGHVHYRGDNKYDLTYDSIDQLPPDGESIHEKYTHRLCHATAISKSTPDYDNATIPIFSWTHRSAEYYNRIYPNKITKIPAVKMYKLGDTSTVVKGPGFTGGDLVKRGSNGYIGDIKATVNSPLSQNYRVRVRYATSVFGLFNVFINDEIALQKNFQSTVETIGEGKDLTYGSFGYIEYSTTIQFPNEHPKITFHLNHLSNNSPFYVDSIEFIPVDVNYDVNYAEKEKLEKAQKAVNALFTEGRNALQKHVTDYKVDQVSILVDCISGDLYPNEKRELQNLVKYAKRLSYSRNLLLDPTFDCINSSEENGWYGSNGIVIGNGDFVFKGNYLIFSGTNDTYLYQKIDESKLKEYTRYKLKGFIESSQDLEAYVIRYDAKHRTLDVSDNLLPDILPENTCGEPNRCAAQQYLDENPSSECSSMQDGILSDSHSFSLNIDTGSINHNENLGIWVLFKISTLEGYAKFGNLEVIEDGPVIGEALARVKRQETKWRNKLAQMTTETQAIYTRAKQALDNLFANAQDSHLKIDVTFAEIAAARKIVQSIREAYMSWLSVVPGVNHPIFTELSGRVQRAFQLYDVRNVVRNGRFLNGLSDWIVTSDVNVQEENGNNVLVLNNWDAQVLQNVKLYQDRGYILRVTARKIGIGEGYITITDEEGHTDQLRFTACEEIDASNAFISGYITKELEFFPDTEKVHIEIGETEGIFLVESIELFLMEELC

SEQ ID NO: 466 - protein, 1154 aa, Bacillus thuringiensis huazhongensis
MDIRNQNKYEVVYPAINETTSNTTSKYPLASDPIKQYQNMNYKDSLNIIEGNNVITPVSGTAVLATARKIGGKIVKAIGEQILSKILKEILDYLWPSSSSSNSWEEMMKEVEYLIDKKIEEYARNKALAVLEGIGNAVESYYSALEAWELESSERSLELVLERYQFAVQFARSSMPSFAIINYEIPLLATYANAANVHLLLMRDIQIYGDRWGISQNDMNLFLKEQEIYTSEYSEHCVKWYNEGLNQLKTKGGASGLVWENYNSFRTEMTIMVLDLVAIFPAYNMSKYPIESTVELTRTIYTDPLGYTGYSNDEHPTYYSSAKPFSSIESRAVLAPSLFKWITQLEVYTKKYSYSSQYTTLWTGLRVIAQPTKDFTDTVYDYGSSSGSENKDVFDLYGNDVYDTQSVVSSYKPTGGGHFGVPQFRLFWITKSNGLREQIFNYANNMGSYSAYRFSKDELPIELLQPPLFGDIEEYSHRLSHVSEVIKDYGEGIIPVLGWTHVSVTRDNRIYPDKITQLPAVKMYELLSSAVVVKGPGFTGGDLVKRTGNGGIGHFNVSVESPGTQRYRLRIRYSSEVSGVFHMQINDIETIQGEFSSTADSTSTLSSEAFQLREYSTTFTFPTNMTKIKVSLGAIEGAGGFYLDRIEFIPVDENHDNRVTLEKAQKAVNALFTAGRNALQTDVTDYKVDQVSILVDCVSGELYPNEKRELLSLVKYAKRLSYSRNLLLDPTFDSINSSDENGWYGSNGIAIGNGNFVFKGNYLIFSGTNDTQYPTYLYQKIDESKLKEYTRYKLRGFIENSQDLEAYVIRYDAKHETLDVSNNLLPDISPVNACGEPNRCAALQYLDENPRLECSSIQDGILSDSHSFSLNIDTGSIDFNENVGIWVLFKISTPEGYAKFGNLEVIEDSPVIGEALARVKRQETKWRNKLTQLRTETQAIYTRAKQAIDNVFTNAQDSHLKIGTTFAAIVAARKIVQSIREAYMSWLSIVPGVNYPIFTELNERVQRAFQLYDVRNVVRNGRFLNGVSDWIVTSDVKVQEENGNNVLVLSNWDAQVLQCLKLYQDRGYILRVTARKEGLGEGYITITDEEGHTDQLTFGTCEEIDASNTFVTTGYITKELEFFPDTEKVRIEIGETEGTFQVESIELFLMEDLC

SEQ ID NO: 467 - protein, 1144 aa, Bacillus thuringiensis BTH-13
MDKQNDSGIIKATLNEDFSNSIQRYPLVTDQTINYKDFLNMNEEIAPYASSKDVIFSSISIIRTFMGFAGHGTAGGIIGLFTEVLRLLWPNKQNDLWESFMNEVEALINQEITEAVVSKALSELEGLRNALEGYTSALEAWQNNRSDKLKQLLVYERFVSTENLFKFAMPSFRSVGFEGPLLTVYAQAANLHLFLLKNAELFGAEWGMQQYEIDLFYNEQKGYVEEYTDHCVKWYKEGLNKLKNASGVKGKVWENYNRFRREMTIMVLDLLPLFPIYDARTYPMETVTELTRQIFTDPIGLTGINETKYPDWYGAASSEFVLIENRAIPKPGLFQWLTKINVRARVVEPNDRFAIWTRHSVVTQCTKSTTENTFNYGTSSGSTLSHTFDLLSKDIYQTYSIAAANKSATWYQAVPLLRLYGINSSNVLSEDAFSFSNNIPSSKCKSTYSSDQLPIELLDEPIYGDLEEYGHRLSYVSEIFKETGSGTIPVLGWTHVSVRPDNKLYPDKITQIPAVKAFETNTAGVEIIDSASTGGPILKIVNNNLPSNQVFRMRLSFSEPQKIKVRVRYAATGDGVMSFSGIAHDEYFTATMKEGEALKYSYLTMGNDYAGTAAELSMLYIIKANTSNCTIYIDKIEFIPVDENYNNRVQLEKAQKAVNTLFTAGRNALQKDVTDFKVDQVSILVDCVSGELYPNEKRELLSLVKYAKRLSYSRNLLLDPTFDSINSSEENGWNGSNGIAIGSGDFVFKGNYLIFSGTNDEQYPTYLYQKIDESKLKEYTRYKLRGFIESSQDLEAYVIRYDAKHETLDVSNNLLPDIPPVNACGEPNRCAALQYLDENPKLECSSIQDGILSDSHSFSLHIDTGSIDFNENVGIWVLFKISTPEGYAKFGNLEVIEDGPVIGEALARVKRQETKWRNKLTQLRTETQAIYTRAKQALDNLFTDAQDSHLKIGATFAAIVAARKIVQSIREAYMSWLSDVPGLNYPIFTELNDRVQRAFQLYDVQNVVRNGRFLNGVLDWIVTSDVKVQEGNGNNVLVLSGWDAQVLQCLNLYQNRGYILRVTARKEGLGEGYITITDEEGNTDQLTFGSCENIDSSNSFVSTGYITKELEFFPDTDQIQIEIGETEGTFQVESVELFLMENLC

SEQ ID NO: 468 - protein, 1144 aa, Bacillus thuringiensis LH-2
MDQQNEYEIIQAGVSNAITDTFQRYPLANNPNTSFQNMNYKDYLNDPMFLGETRDAQTAITTSLEIISEILGFLGVPFVGPIIGFTNRLINLLWPRNTTDIWNAFMDEVQALINESITKAVRSKAISELEGIHQVYRLYIEALNEWKDTPDNPFVQERVRTTFRDVNSIINYAMPSFRVQGFEIPLLVVYAQAANLHLVLLRDATLFGAGWGFTETNINDRYNEQVRVTNGYIDHCTKWYNEGLTRLKNNWSKYHQFRREMTLMVLDLIALFPSHDARRYPMETSAQLTRDVYTDPIGYRGNANFSDPWTNHVSFSKAESETIRPPHLFDTLESVEINTAKAMLPLNDKSYMYYWAGHTVTSRLLDSSGNPLKYTYGSMTSEKNLVSLPGKDVYRINSVASGFSNYYAKLYGVSKVDFSIVDRNNSNKTTYSYSKSSTVPSDNKENRDSENELPQTTTDQPDYKGYSHRLSHITFISSAIPTYVWTRKSADLTNTIYPDKITQIPAVKMYELGSSAVVVKGPGFTGGDLVKRTNNGSLGRFKITIDSPGAHRYRLRVRYHSDVSGVFHMQINNVETIQGEFKSTVDSTSTMSNDSFQLREFTTTFRFPSNVTDIKVSLGAINGQGNFYLDRIEFAPVDTNYDERITLEKAQKAVNALFTEGRNALQTDMTDYKVDQVSILVDCVSGEVYPNEKRELLNLVKYAKRLSIARNLLVDPNFTSIHASMYSEDVKGWYGSNGIATGSGDVVLKENYVSLPSTSDAQYPTYLYQKIDESKLKAYTRYKLRGFIENSQDLEAYVVRYDAKHETLDVSNNLLPDVLPVNACGEPDRCAALQYLDENPRLECSSIQDGILSDSHSFSLNIDTGSMDLNENLGIWVLFKISTPEGYAKFGNLEVIEDGTVSGEALARVKRQETKWRNKLAQLRTETQAIYTRAKQALDNLFTDAQDSYLKIGATFAAIVAARKIVQSIREAYMSWLSVVPGVNYPIFTELNERVQRAFQLYDGRNVVRNGRFLNGVLDWIVTSDVSVQEENGNNVLVLSNWDAQVLQCLKLYQDRGYILRVTARKEGLGEGYITITDEEGNTDQLTFGSCEEIDTSNSFVSTGYMTKELEFFPDTEKVRIEIEETEGTFKVESVELFLMEDLC

SEQ ID NO: 469 - protein, 1157 aa, Bacillus thuringiensis serovar tochigiensis BGSC 4Y1
MDTRNQKKYEELQPALNDTFSNTAPKYPLACDPTKQCQNMNYKDYLNMTEGGAPYVSSRDVIFSSLAITRTFLGLAGLGTAGGMIGLFTEALRLLWPNKTEDLWKAFMDEVEKLINQKITDAVVSKALSELQGLANALEGFTNALEAWQNNRSDKLQQLLVYERFVATETLFKYAIPSFRVSGFEVPLLTVYAQAANLHLCLLKNAELFGADWGMPQYEIDVFYNEQKGYIEEYTDHCVTWYNSGLNQLKNVSGVKGKVWENYNRFRREMTIMVLDILPLFPIYDTRTYLMETTIELTRQIFTDPIGLTGINETKYPDWYEAASTEFILIENNAVPKPTLFQWLTKFNVWGRTVNPNDTFTIWTGHSVVTRYTKDSAEHTFNYGTSSGSTLSYTFDLLSKDVYQTYSLAETNKSATWYFAVPMLKLYSINNNNKLSEEYFSFPTNIPSSKGKRTYSSDQLPIELSDSPIYGDLEEYSHRLSYVSEIFKKTGSGTIPVLGWTHVSVSPDNRIFTDKITKLPVVKATQLSGEVITGPGFTGGNIIKSNVASTEPTKIIVLLNISPPSSKTKYSFRIRYAADAPGRLQITDGNYIAGLTQEFKATMEVGSSLKYNSFQYLTFSTGSLGTGSNYLKIYALQSPSSFSYNIYIDSIECIPVPVNYDDSVTLENAQKAVNALFTASSNALKREVTDYVVDQASILVDCVSEELYPNEKRELLHLVKYAKRLSAVRNLLLDPTFESINSSDVNGWYGSNGIAIGSGDFVFKGKYVSLPGTNDERYPTYLFQKIDESKLKEYTRYKLRGFVESSQDLEVYVIRYDAKHETLHVSDNLIPNVPPVNECGEPNRCAQQQYLSGNPTLEQYYVTKGVLYDSHAFSLDIDTGSVDPNEHLGIWVLFKISTTRGFAKLGNVEVIEDGLLTGEALARVKRKETKWKNKLEQLRAETQAISTRANQALDSLFADAQDSKLKLGVTFATIVAARKIVQSIRDVYMPWLSIVSGVNYSIFTELMGRVQLALQLYDLRNMVRNGRFLNGISDWGVTSDVKVQEEDGNLVLVLSNWDAQVLQCVKLYPDRGYILRVTARKEGLGEGYVTICGEEGNTDTLTFGTCDDTDRLQSVVSTGYVTKELEFFPDTENVQIEIGETEGVFQVESVELFLMEE

SEQ ID NO: 470 - protein, 1117 aa, Bacillus thuringiensis serovar tochigiensis BGSC 4Y1
MRVNRNELRTLPEGFASSTESAVTNTLNIISIILDATGHPVAGKVLGVITGILGILWPGGSEKAWEEFMEAVEQLVDEKITDAFKSEALSKLDGLSQLYNVYLSELELWIERPNDPSVIQSVRTRFLDLDSEFISSMPQFAINGFEIQFLPVYAHAANLHLLLLRDLSYYGKNWGLQEPEIENFYKRQMDNIQKYTDHCVEWYERGLQEVYNSFTSTNINEDGGLPWTHYNRYRREMTVYVLDLIATFPTNDWKKYHLETNVELSREIYTDPLGYEDDDTEDITDVDWYSEGVSFSEIENMHPPRLVEWLNKVYIYTDYFEAGSDESYAWVSHIITSSFTDSNEEHSRSYGSTESVEESEGISFYPAEIYKVVSVVGSERNATYDNYVNSANTFYGVTPTNELKTFTYSYRNDYDKKTLYSDDQLPLETDTPKYGEYSHRLSNITIAPLNSDDFGLVPILGWTHTSLKRENRIYPDKITQIPAVKSVEGGVVVKGPGFTGGNLIKAETTQGQIVKIVKFKVKVDGSLSQKYRVRVNYAANSDGRIDFYFAGQVVLQSDFIKTMDNNDISKFSSFGYLDIDFPFNFSHSELEVLSQISLKTTGVFYINNIEFIPEIEGYDEKVTLEKAQKAVNALFTAGRNAIQTDVTDYKVDQVSNLVDCVSEELYPNEKQELQNLVKYAKRLSISRNLLLDPNFTSINAPKVRGWHGSPGIIVGNGNYIFKGPYVHLQGTNDAQDPTYLYQKIDESKLKEYTRYKLRGFIESSQDLEVSVIRYDAKHETVDVSDNLLSDNLPKNACGEPNRCILQQYIENNPTLECSSIQDGILFDSHSFSLNIDTGSINYNENVGIWVVFKISTLEGYAKVGNIEVIEEAPLVGEALARVKRQETKWRNKLEQLRAETQVIYTRAKQAIDNLFTDIQDSKLKMEVTFATIVAAREIVQSIREAYMPWLSVVPGVNYPIFTELNVRVRRALQLYDLRNVVRNGRFRHGLSNWIVTSDVKIQEENGNNVLVLSGWDAQVLQHVKLYPDRGYILRVTAHKEGLGEGYITIMDEEGHTDQLTFGACEKIDASNTFMSTGYITKELEFFPDTEKVHIEIGETEGIFKVESIALFLMEEQC

SEQ ID NO: 471 - protein, 1157 aa, Bacillus thuringiensis kumamotoensis
MSPNNQNEYEIIDATPSTSVSSDSNRYPFANEPTDALQNMNYKDYLKMSGGENPELFGNPETFISSSTIQTGIGIVGRILGALGVPFASQIASFYSFIVGQLWPSKSVDIWGEIMERVEELVDQKIEKYVKDKALAELKGLGNALDVYQQSLEDWLENRNDARTRSVVSNQFIALDLNFVSSIPSFAVSGHEVLLLAVYAQAVNLHLLLLRDASIFGEEWGFTPGEISRFYNRQVQLTAEYSDYCVKWYKIGLDKLKGTTSKSWLNYHQFRREMTLLVLDLVALFPNYDTHMYPIETTAQLTRDVYTDPIAFNIVTSTGFCNPWSTHSGILFYEVENNVIRPPHLFDILSSVEINTSRGGITLNNDAYINYWSGHTLKYRRTADSTVTYTANYGRITSEKNSFALEDRDIFEINSTVANLANYYQKAYGVPGSWFHMVKRGTSSTTAYLYSKTHTALQGCTQVYESSDEIPLDRTVPVAESYSHRLSHITSHSFSKNGSAYYGSFPVFVWTHTSADLNNTIYSDKITQIPAVKGDMLYLGGSVVQGPGFTGGDILKRTNPSILGTFAVTVNGSLSQRYRVRIRYASTTDFEFTLYLGDTIEKNRFNKTMDNGASLTYETFKFASFITDFQFRETQDKILLSMGDFSSGQEVYIDRIEFIPVDETYEAEQDLEAAKKAVNALFTNTKDGLRPGVTDYEVNQAANLVECLSDDLYPNEKRLLFDAVREAKRLSGARNLLQDPDFQEINGENGWAASTGIEIVEGDAVFKGRYLRLPGAREIDTETYPTYLYQKVEEGVLKPYTRYRLRGFVGSSQGLEIYTIRHQTNRIVKNVPDDLLPDVSPVNSDGSINRCSEQKYVNSRLEGENRSGDAHEFSLPIDIGELDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWNLYDQRNAIPNGDFRNGLSNWNATPGVEVQQINHTSVLVIPNWDEQVSQQFTVQPNQRYVLRVTARKEGVGNGYVSIRDGGNQSETLTFSASDYDTNGVYNDQTGYITKTVTFIPYTDQMWIEISETEGTFYIESVELIVDVE

SEQ ID NO: 472 - protein, 1180 aa, Bacillus thuringiensis B-JJX
MSPNNQNEYEIIDATPSTSVSNDSNRYPSANEPTNALQNMNYKDYLRISEGYDSEYSGSPGAFISEKDAIKVGIDIVGNILGKLGVPFASQIVSFYNFILDQLWPSNSVSVWEQIMTLVEELVDQKITEYARNKALAELKGLGDALGVYQQSLEAWLENRNDTRARSVVSNQFIALELDFVGAIPSFAVSGQEVPLLAVYAQAVNMHLLLLRDASIFGEEWGFTSSEISTYYNRQVQLTSQYSDYCVKWYDTGLQKLKGTSAESWLEYHQFRREMTFMVLDLVALFPNYDTHTYPLETKAQLTREVYTDPIAFNLSGAAGFCRPWSKYTGISFSEIENAVIRPPHLFNVLRSLEINTVRGTILGNTKDYLNYWSGHSLQYNFIGNITVRESNYGYLTSEKTRIQLDTRDIFEINSTAASLANYYQETYGVPESRFHLVRWASPYDTSSHLYSKTHTTGEGCTQVYESSEEIPVDRTVPVNEGYGHRLSYVTALFFQKIINTFYRNGTLPVFVWTHRSADLTNTIYPDKITQIPAVKGDQLWDGTSVVAGPGFTGGDIIRKTYGNTGYEIINVSLEVPNPNQDYFIRIRYAATNDITLSVNLFPGFLTGNFQSTMNKGEPLTYGKFKYANFQSTKFNSSKQTIRLSVSGLTVPSGTEIYIDKIEFIPVDATYEAETDLEAAKKAVKALFSNTTDTLLPGVTDYEVNQAANLVECLSDDLYPNEKRLLFDAVREAKRLSEARNLLQDPDFQEINGENGWTASTGVEIIEGDAVFKGRYLRLPGAREMDTETYPTYVYQKIEEGVLKPYTRYRLRGFVGSSQGLEIYTIRHQTNRIVKNVPDDLLPDVTSVNAGGGINRCSEQKYVNSRLEGERGLPNGNRSAEAHEFSLPINIGELDYNENAGIWVGFKITDPEGYATLGNLGLVEEGPLSGDALERLQREEQQWKLQMTKRREETDRKYTAAKQAVDRLYADYQDQQLNPNVEITDITAAQDLIQSIPYVYNEIFPEIQGMNYAKFTELSNRLQRAWGLYDQRNAIPNGDFRNGLSNWNTTPGVEVQQINDTSVLVIPNWDEQVSQQFTVQPNQRYVLRVTARKEGVGNGYVSIRDGGNQTETLTFSASDYDTNSVYNTQASNTNGLYNEQTGYITKTVTFIPYTDQVWIEMSETEGTFYIESVELIVDVE

SEQ ID NO: 473 - protein, 1169 aa, Bacillus thuringiensis kumamotoensis
MSPNNQNEYEIIDATPSTSVSNDSNRYPFANEPTNALQNMDYKDYLKMSAGNVSEYPGSPEVFLSEQDAVKAAIDIVGKLLTGLGVPFVGPIVSLYTQLIDILWPSKQKSQWEIFMEQVEELINQKIAEYARNKALSELEGLGNNYQLYLTALEEWKENPNGSRALRDVRNRFEILDSLFTQYMPSFRVTNFEVPFLTVYTMAANLHLLLLRDASIFGEEWGLSTSTINNYYNRQMKLTAEYSDHCVKWYETGLAKLKGSSAKQWIDYNQFRREMTLTVLDVVALFSNYDTRTYPLATTAQLTREVYTDPLGAVDVPNIGSWYDKAPSFSEIEKAAIRPPHVFDYITGLTVYTKKRSFTSDRYMRYWAGHQISYKHIGTSSTFTQMYGTNQNLQSTSNFDFTNYDIYKTLSNGAVLLDIVYPGYTYTFFGMPETEFFMVNQLNNTRKTLTYKPASKDIIDRTRDSELELPPETSGQPNYESYSHRLGHITFIYSSSTSTYVPVFSWTHRSADLTNTVKSGEITQIPGGKSSTIGRNTYIIKGRGYTGGDLVALTDRIGSCEFQMIFPESQRFRIRIRYASNETSYISLYGLNQSGTLKFNQTYSNKNENDLTYNDFKYIEYPRVISVNASSNIQRLSIGIQTNTNLFILDRIEFIPVDETYEAETDLEAAKKAVNALFTNTKDGLQPGVTDYEVNQAANLVECLSDDLYPNEKRLLFDAVREAKRLSEARNLLQDPDFQEINGENGWTASTGIEVIEGDAVFKGRYLRLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGELDYNENAGIWVGFKITDPEGYATLGNLELVEEGPLSGDALERLQKEEQQWKIQMTRRREETDRRYMASKQAVDRLYADYQDQQLNPNVEITDLTAAQDLIQSIPYVYNEMFPEIPGMNYTKFTELTDRLQQAWGLYDQRNAIPNGDYRNELSNWNTTSGVNVQQINHTSVLVIPNWNEQVSQKFTVQPNQRYVLRVTARKEGVGNGYVSIRDGGNQSETLTFSASDYDTNGMYDTQASNTNGYNTNSVYMIKPAISRKTVDISSVYNQMWIEISETEGTFYIESVELIVDVE

SEQ ID NO: 474 - protein, 1206 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGEKSQWEIFMEQVEELINQKIAEYARNKALSELEGLGNNYQLYLTALEEWEENPNGSRALRDVRNRFEILDSLFTQYMPSFRVTNFEVPFLTVYAMAANLHLLLLKDASIFGEEWGWSTTTINNYYDRQMKLTAEYSDHCVKWYETGLAKLKGTSAKQWVDYNQFRREMTLAVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRVSRGSNLQQMYGTNQNLHSTSTFDFTNYDIYKTLSKDAVLLDIVYPGYTYIFFGMPEVEFFMVNQLNNTRKTLKYNPVSKDIIASTRDSELELPPETSDQPNYESYSHRLCHITSIPATGNTTGLVPVFSWTHRSADLNNTIYSDKITQIPAVKCWDNLPFVPVVKGPGHTGGDLLQYNRSTGSVGTLFLARYGLALEKAGKYRVRLRYATDADIVLHVNDAQIQMPKTMNPGEDLTSKTFKVADAITTLNLATDSSLALKHNLGEDPNSTLSGIVYVDRIEFIPVDETYEAEQDLEAAKKAVNALFTNTKDGLRPGVTDYEVNQAANLVECLSDDLYPNEKRLLFDAVREAKRLSEARNLLQDPDFQEINGENGWTASTGIEVIEGDALFKGRYLRLPGAREIDTETYPTYLYQKVEEGVLKPYTRYRLRGFVGSSQGLEIFTIRHQTNRIVKNVPDDLLPDVSPVNSDGSINRCSEQKYVNSRLEVENRSGEAHEFSIPIDTGEIDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWSLYDQRNAIPNGDFRNGLSNWNATPGVEVQQINHTSVLVIPNWDEQVSQQFTVQPNQRYVLRVTARKEGVGNGYVSIRDGGNQTETLTFSASDYDTNGMYNTQVSNTNGYNTNNAYNTQASSTNGYNANNMYNTQASNTNGYNTNSVYNDQTGYITKTVTFIPYTDQMWIEMSETEGTFYIESVELIVDVE

SEQ ID NO: 475 - protein, 1210 aa, Bacillus thuringiensis
MSPNNQNEYEIIDATPSTSVSNDSNRYPFANEPTNALQNMDYKDYLKMSAGNASEYPGSPEVLVSGQDAAKAAIDIVGKLLSGLGVPFVGPIVSLYTQLIDILWPSGQKSQWEIFMEQVEELINQKIAEYARNKALSELEGLGNNYQLYLTALEEWKENPNGSRALRDVRNRFEILDSLFTQYMPSFRVTNFEVPFLTVYTQAANLHLLLLKDASIFGEEWGWSTTTINNYYDRQMKLTAEYSDHCVKWYETGLAKLKGTSAKQWVDYNQFRREMTLTVLDVVALFPNYDTRTYPMETKAQLTREVYTDPLGAVNVSSIGSWYDKAPSFGVIESSVIRPPHVFDYITGLTVYTQSRSISSARYIRHWAGHQISYHRIFSDNIIKQMYGTNQNLHSTSTFDFTNYDIYKTLSKDAVLLDIVFPGYTYIFFGMPEVEFFMVNQLNNTRKTLKYNPVSKDIIAGTRDSELELPPETSDQPNYESYSHRLCHITSIPATGSTTGLVPVFSWTHRSADLINAVHSDKITQIPVVKVSDLAPSITGGPNNTVVSGPGFTGGGIIKVIRNGVIISHMRVKISDINKEYSMRIRYASANNTEFYINPSEENVKSHAQKTMNRGEALTYNKFNYATLPPIKFTTTEPFITLGAIFEAEDFLGIEAYIDRIEFIPVDETYEAEQDLEAAKKAVNALFTNTKDGLRPGVTDYEVNQAANLVECLSDDLYPNEKRLLFDAVREAKRLSEARNLLQDPDFQEINGENGWTASTGIEVIEGDALFKGRYLRLPGAREIDTETYPTYLYQKVEEGVLKPYTRYRLRGFVGSSQGLEIFTIRHQTNRIVKNVPDDLLPDVSPVNSDGSINRCSEQKYVNSRLEVENRSGEAHEFSIPIDTGEIDYNENAGIWVGFKITDPEGYATLGNLELVEEGPLSGDALERLQREEQQWKIQMTRRREETDRRYMASKQAVDRLYADYQDQQLNPDVEITDLTAAQDLIQSIPYVYNEMFPEIPGMNYTKFTELTDRLQQAWSLYDQRNAIPNGDFRNGLSNWNATPGVEVQQINHTSVLVIPNWDEQVSQQFTVQPNQRYVLRVTARKEGVGNGYVSIRDGGNQTETLTFSASDYDTNGMYNTQVSNTNGYNTNNAYNTQASSTNGYNANNMYNTQASNTNGYNTNSVYNDQTGYITKTVTFIPYTDQMWIEMSETEGTFYIESVELIVDVE

SEQ ID NO: 476 - protein, 1160 aa, Bacillus thuringiensis japonensis Buibui
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTSAREIDTETYPTYLYQQIDESLLKPYTRYKLKGFIGSSQDLEIKLIRHRANQIVKNVPDNLLPDVRPVNSCGGVDRCSEQQYVDANLALENNGENGNMSSDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 477 - protein, 1160 aa, Bacillus thuringiensis HBF-1
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTNAREIDTETYPTYLYQQIDESLLKPYTRYKLKGFIGSSQDLEIKLIRHRANQIVKNVPDNLLPDVRPVNSCGGVDRCSEQQYVDANLALENNGENGNMSSDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 478 - protein, 1160 aa, Bacillus thuringiensis FTL-23
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLPGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTSAREIDTETYPTYLYQQIDESLLKPYTRYKLKGFIGSSQDLEIKLIRHRANQVVKNVPDNLLPDVRPVNSCGGVDRCSEQQYVDANLALENNGENGNMSFDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 479 - protein, 1160 aa, Bacillus thuringiensis S185
MSPNNQNEYEIIDALSPTSVSDNSIRYPLANDQTNTLQNMNYKDYLKMTESTNAELSRNPGTFISAQDAVGTGIDIVSTIISGLGIPVLGEVFSILGSLIGLLWPSNNENVWQIFMNRVEELIDQKILDSVRSRAIADLANSRIAVEYYQNALEDWRKNPHSTRSAALVKERFGNAEAILRTNMGSFSQTNYETPLLPTYAQAASLHLLVMRDVQIYGKEWGYPQNDIDLFYKEQVSYTARYSDHCVQWYNAGLNKLRGTGAKQWVDYNRFRREMNVMVLDLVALFPNYDARIYPLETNAELTREIFTDPVGSYVTGQSSTLISWYDMIPAALPSFSTLENLLRKPDFFTLLQEIRMYTSFRQNGTIEYYNYWGGQRLTLSYIYGSSFNKYSGVLAGAEDIIPVGQNDIYRVVWTYIGRYTNSLLGVNPVTFYFSNNTQKTYSKPKQFAGGIKTIDSGEELTYENYQSYSHRVSYITSFEIKSTGGTVLGVVPIFGWTHSSASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTSAREIDTETYPTYLYQQIDESLLKPYTRYKLKGFIGSSQDLEIKLIRHRANQIVKNVPDNLLPDVRPVNSCGGVDRCSEQQYVDANLALENNGENGNMSSDSHAFSFHIDTGEIDLNENTGIWIVFKISTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLRVTARKEGVGDGYVIIRDGANQTETLTFNICDDDTGVLSTDQTSYITKTVEFTPSTEQVWIDMSETEGVFNIESVELVLEEE

SEQ ID NO: 480 - protein, 1144 aa, Bacillus thuringiensis galleriae
MSPNNQNEYEILDASSSTSVSDNSVRYPLANDQTTTLQNMNYKDYLRMSEGENPELFGNPETFISSSTVQTGIGIVGQVLGALGVPFAGQIASFYSFIVGQLWPSSTVSVWEMIMKQVEDLIDQKITDSVRKTALAGLQGLGDGLDVYQKSLKNWLENRNDTRARSVVVTQYIALELDFVAKIPSFAISGQEVPLLSVYAQAANLHLLLLRDASIFGAEWGFTPGEISTFYDRQVTRTAQYSDYCVKWYNTGLDKLKGTNAASWLKYHQFRREMTLLVLDLVALFPNYDTRTYPIETTAQLTREVYTDPIVFNRETSGGFCRRWSLNSDISFSEVESAVIRSPHLFDILSEIEFYTTRAGLPLNNTEYLEYWVGHSIKYKNTNASSALERNYGTITSNKIKYYDLANKDIFQVRSLGADLANYYAQVYGVPYASFTLLDKNTGSGSVGGFTYSKPHTTMQVCTQNYNTIDEIPPENEPLSRGYSHRLSHITSYSFSKNASSPARYGNLPVFAWTHRSADVTNTVYSDKITQIPVVKAHTLVSGTTVIKGPGFTGGNILKRTSSGPLAYTSVSVKSPLSQRYRARIRYASTTNLRLFVTISGTRIYSINVNKTMNKGDDLTFNTFDLATIGTAFTFSNYSDSLTVGADSFASGGEVYVDKFELIPVNATFEAEEDLDVAKKAVKNLVECLSDELYPNEKRMLWDAVKEAKRLVQARNLLQDTGFNRINGENGWTGSTGIEVAEGDVLFKDRSLRLTSAREIDTETYPTYLYQQIDESLLKPYTRYKLKGFIGSSQDLEIKLIRHRANQIVKNVPDNLLPDVLPVNSCGGIDRCSEQQYVDANLALENNGENGNMSSDSHAFSFHIDTGEIDLNENTGIWVVFKIPTTNGYATLGNLELVEEGPLSGETLERAQQQEQQWQDKMARKRGASEKAYYAAKQAIDRLFADYQDQKLNSGVEMSDMLAAQNLVQSIPYVYNDALPEIPGMNYTSFTELTNRLQQAWNLYDLRNAIPNGDFRNGLSDWNATSDVNVQQLSDTSVLVIPNWNSQVSQQFTVQPNYRYVLRVTARKEGVGDGYVIIRDGANQTETLTFNICDDDTGVLSADQTSYITKTVEFTPSTEQVWIDMSETEGVFNIESVELVLEEE

SEQ ID NO: 481 - protein, 1167 aa, Bacillus thuringiensis
MSPNNQNEYEILDASSSTSVSDNSVRYPLANDQTTTLQNMNYKDYLRMSEGENPELFGNPETFISSSTVQTGIGIVGQVLGALGVPFAGQIASFYSFIVGQLWPSSTVSVWEMIMKQVEDLIDQKITDSVRKTALAGLQGLGDGLDVYQKSLKNWLENRNDTRARSVVVTQYIALELDFVAKIPSFAISGQEVPLLSVYAQAANLHLLLLRDASIFGAEWGFTPGEISTFYDRQVTRTAQYSDYCVKWYNTGLDKLKGTNAASWLKYHQFRREMTLLVLDLVALFPNYDTRTYPIETTAQLTREVYTDPIVFNRETSGGFCRRWSLNSDISFSEVESAVIRSPHLFDILSEIEFYTTRAGLPLNNTEYLEYWVGHSIKYKNTNASSALERNYGTITSNKIKYYDLANKDIFQVRSLGADLANYYAQVYGVPYASFTLLDKNTGSGSVGGFTYSKPHTTMQVCTQNYNTIDEIPPENEPLSRGYSHRLSHITSYSFSKNASSPARYGNLPVFAWTHRSADVTNTVYSDKITQIPVVKAHTLVSGTTVIKGPGFTGGNILKRTSSGPLAYTSVSVKSPLSQRYRARIRYASTTNLRLFVTISGTRIYSINVNKTMNKGDDLTFNTFDLATIGTAFTFSNYSDSLTVGADSFASGGEVYVDKFELIPVNATFEAEEDLDVAKKAVNGLFTSKKDALQTSVTDYQVNQAANLVECLSDELYPNEKRMLWDAVKEAKRLVQARNLLQDTGFNRINGENGWTGSTGIEVAEGDVLFKDRSLRLTSAREIDTETYPTYLYQQIDESLLKPYTRYKLKGFIGSSQDLEIKLIRHRANQIVKNVPDNLLPDVLPVNSCGGIDRCSEQQYVDANLALENNGENGNMSSDSHAFSFHIDTGEIDLNENTGIWVVFKIPTTNGYATLGNLELVEEGPLSGETLERAQQQEQQWQDKMARKRGASEKAYYAAKQAIDRLFADYQDQKLNSGVEMSDMLAAQNLVQSIPYVYNDALPEIPGMNYTSFTELTNRLQQAWNLYDLRNAIPNGDFRNGLSDWNATSDVNVQQLSDTSVLVIPNWNSQVSQQFTVQPNYRYVLRVTARKEGVGDGYVIIRDGANQTETLTFNICDDDTGVLSADQTSYITKTVEFTPSTEQVWIDMSETEGVFNIESVELVLEEE

SEQ ID NO: 482 - protein, 1174 aa, Bacillus thuringiensis BBT2-5
MSPNNQNEYEILDASSSTSVSDSSVRYPLANDQTTTLQNMNYKDCLRMSEGENPELFGNPETFISSSTVQTGIGIVGQVLGALGVPFAGQIASFYSFIVGQLWPSSTVSVWEMIMKQVEDLIDQKITDSVRKTALAGLQGLGDGLDVYQKSLKNWLENRNDTRARSVVVTQYIALELDFVAKIPSFAISGQEVPLLSVYAQAANLHLLLLRDASIFGAEWGFTPGEISTFYDRQVTRTAQYSDYCVKWYNTGLDKLKGTNAASWLKYHQFRREMTLLVLDLVALFPNYDTRTYPIETTAQLTREVYTDPIVFNRETSGGFCRRWSLNSDISFSEVESAVIRSPHLFDILSEIEFYTTRAGLPLNNTEYLEYWVGHSIKYKNTNASSALERNYGTITSNKIKYYDLANKDIFQVRSLGADLANYYAQVYGVPYASFTLLDKNTGSGSVGGFTYSKPHTTMQVCTQNYNTIDEIPPENEPLSRGYSHRLSHITSYSFSKIASSPARYGNLPVFAWTHRSADVTNTVYSDKITQIPVVKGIDLGSTSTIVNFEYNGGSIVKDTKSSTHNNSLSRIVSLMIKTEDPNPNSRSLYRIRVKYAADVPGTFRLHIQNTSPVTVPFTATMSGTNLQYSSFKYIEYIGYFNNREVGFSIESSTSQGRTRNVYIDKIEFIPVDATYIAEEDLEVAKKAVNGLFTNTKDALQTSVTDYQVNQAANLVECLSDELYPNEKRMLWDAVKEAKRLVQARNLLQDTGFNRINRENGWTGSTGIEIVEGDVLFKDRSLRLTSAREIDTETYPTYLYQQIDESLLKPYTRYKLKGFIGSSQDLEIKLIRHRANQIVKNVPDNLLPDVLPVNSCGGIDRCSEQQYVDANLALENNGENGNMSSDSHAFSFHIDTGEIDLNENTGIWVVFKIPTTNGYATLGNFELVEEGPLSGETLERAQQQEQQWQDKMARKRGASEKAYYAAKQAIDRLFADYQDQKLNSGVEMSDMLAAQNLVQSIPYVYNDALPEIPGMNYTSFTELTNRLQQAWNLYDLRNAIPNGDFRNGLSDWNATSDVNVQQLSDTSVLVIPNWNSQVSQQFTVQPNYRYVLRVTARKEGVGDGYVIIRDGANQTETLTFNICDDDTGVLSADQTSYITKTVEFTPSTEQVWIDMSETEGVFNIESVELVLEEE

SEQ ID NO: 483 - protein, 1164 aa, Bacillus thuringiensis 185
MSPNNQNEYEIIDMAPSTSVSNDSNRYPFASDPTNALQNMNYKEYLRMSEGYDSEYSGSPEVLISERDAVKTAISLVGTILGKLGVPLVGPIVSLYSTLIDVLWPGGKSQWEIFMEQVEALINQKIAEYARAKALAELEGLGNNYQLYLTALEEWQENPSSTRVLRDVRNRFEILDSLFTQYMPSFRVTGYEVPLLSVYAQAANLHLLLLKDASIFGEEWGFSTTAINNYYNRQMSLIAQYSDHCVQWYRTGLDRLKGSNAKQWVEYNRFRREMTLSVLDIMTLFPMYDMRTYPMETKAQLTREVYTDPIGAIGAQGSWYDSAPSFNTLESTFIRGKHLFDFITRLSIYTGRSSFSASNYLKKWIGHQISSQPIGGSIQTQTYGTTSGSSVIATQQIGFTGFDVYKTLSTAGVLFAYTSKYYGVSKVVFDAIYPDNKYKTTFTYNPGSEGIGAQEKDSEVELPPETLDQPNYEAYSHRLNYVTFIRNPDVPVFSWTHRSADRTNTVYSDKITQIPVVKASDGPKPSANEVGHYLGGDPISFNSSGSTGVIRLNINSPLSQKYRVRIRYCSSVDFDLDVVRGGTTVNNGRFNKSAPNVGWQSLKYENFKFASFSTPFTFNQAQDTLKISVRNFSSIVGGSVVYIDRIELIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 484 - protein, 1164 aa, Bacillus thuringiensis B-DLL
MSPNNQNEYEIIDMAPSTSVSNDSNRYPFASDPTNALQNMNYKEYLRMSEGYDSEYSGSPEVLISERDAVKTAISLVGTILGKLGVPLVGPIVSLYSTLIDVLWPGGKSQWEIFMEQVEALINQKIAEYARAKALAELEGLGNNYQLYLTALEEWQENPSSTRVLRDVRNRFEILDSLFTQYMPSFRVTGYEVPLLSVYAQAANLHLLLLKDASIFGEEWGFSTTAINNYYNRQMSLIAQYSDHCVQWYRTGLDRLKGSNAKQWVEYNRFRREMTLSVLDIMTLFPMYDMRTYPMETKAQLTREVYTDPIGAIGAQGSWYDSAPSFNTLESTFIRGKHLFDFITRLSIYTGRSSFSASNYLKKWIGHQISSQPIGGSIQTQTYGTTSGSSVIATQQIGFTGFDVYKTLSTAGVLFAYTSKYYGVSKVVFDAIYPDNKYKTTFTYNPGSEGIAAQEKDSEVELPPETLDQPNYEAYSHRLNYVTFIRNPDVPVFSWTHRSADRTNTVYSDKITQIPVVKASDGPKPFVNEVGHYLGGEPISFISSGSTGVIRLNINSPLSQKYRVRIRYCSSVDFDLDVVRGGTTVNNGRFNKSAPNVGWQSLKYENFKFASFSTPFTFNQAQDTLKISVRNFSSIVGGSVVYIDRIELIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVERDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELIEEGPLSGDALERLQREEQQWKLQMTKRREETDRKYTAAKQAVDRLYADYQDQQLNPNVEITDITAAQHLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 485 - protein, 1174 aa, Bacillus thuringiensis 185
MSPNNQNEYEIIDMAPSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMETTTELTRVVYTDPIVFDERKGVASTHSWTAIAPSFSSIESLTRRPGLFTWLDQLTIFSKRISQPSVFINSWAGHKISTFRTQKTDILINTTHGDTNNPIKEFVVDTKKVEDIYQTIAYPHAVANEVFYLFGVPKVDFNMVPAGGSANSAHTLIFSDSTGGRLESITKNSEAELPPTESLSDTPQPNQVTYSHRLDYATIIKANKSYGSGYIPLLGWTHRSVDRNNTIYPNKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 486 - protein, 1174 aa, Bacillus thuringiensis DLL
MSPNNQNEYEIIDMAPSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMETTTELTRVVYTDPIVFDERKGVASTHSWTAIAPSFSSIESLTRRPGLFTWLDQLTIFSKRISQPSVFINSWAGHKISTFRTQKTDILINTTHGDTNNPIKEFVVDTKKVEDIYQTIAYPHAVANEVFYLFGVPKVDFNMVPAGGSANSAHTLIFSNSTGGRLESITKNSEAELPPTESLSDTPQPNQVTYSHRLDYATIIKANKSYGSGYIPLLGWTHRSVDRNNTIYPNKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGGSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 487 - protein, 1174 aa, Bacillus thuringiensis L-27
MSPNNQNEYEIIAYGTSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMETTTELTRVVYTDPIVFDERKGVASTHSWTAIAPSFSSIESLTRRPGLFTWLDQLTIFSKRISQPSVFINSWAGHKISTFSTQKTDILINTTHGDTNNPIKEFVVDTKKVEDIYQTIAYPHAVANEVFYLFGVPKVDFNMVPAGGSANSAHTLIFSDSTGGRLESITKNSEAELPPTESLSDTPQPNQVTYSHRLDYATIIKANKSYGSGYIPLLGWTHRSVDRNNTIYPNKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYEAEQDLDSAKKAVNTLFTNTKDGLRPGVTDYEVNQAANLVECLSDDLYPNEKRLLFDAVKEAKRLSEARNLLQDPDFQEINGENGWTASTGIEVVEGDALFKGRYLRLPGAREMDTETYPTYLYQKVEEGVLKPYTRYRLRGFVGSSQGLEISTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYTAAKQAVDRLYADYQDQQLNPNVEITDITAAQNLIQSIPYVYNEMFPEIQGMNYTKYTELTNRLQQAWGLYDQRNAIPNGDFRNELSNWNTTSGVNVQQINNTSVLVMPNWDGQVSQQFTVQPNQRYVLRVTARKEGVGNGYVSIRDGGNQTETLTFSASDYNTDSVYNTQVSNTNGLYNEQTGYTTKTVTFIPYTDQVWIEMSETEGMFYIESVELIVDVE

SEQ ID NO: 488 - protein, 1157 aa, Bacillus thuringiensis HBF-18
MSPNNQNEYEIIDASSPTSVSNNSVKYPLASDQTTTLQNMNYKDYLRMSEGENPELFGNPETFISAQDAVGTGIDIVSKLLGSLGVPLVGQAATALKWIIGKLWPSSGNPWDDLMTAVEELINQKIEAYARSKALAELGVSGRAVKSYQTALEEWQKNPNNARSAALVRERFSDAEHTLRTQMSLFTVRGYEIPLLATYAQAANLHLFVMKDIQIYGREWGYTQGDINLFYREQVEFTGEYSDYCVKWYNAGLDKLRGSTALQWINYNRFRREMTVMALDIVALFPNYDIRMYPMKTTAELTRRIYTDPLGYTGSGSNTPPWYNYGYSFSWIENNAVPAPGLFQWLQGIGIYTKFARITPFYANYWSGHTVFYKFTNDSTERRVQYGDTDTPELDSSSFENVDIYKVSASVGSYKSNTVLLPTFKATFEGVNQNNQLKTFRYQKESNVPSQTKNSTTELPVQLSTPPTYGDSEQYSHRLAYVFDAPIDSYTGIYRMYGFAPILGWTHISVSRDNRIDPDKITQIPAVKAYAEGLANYIKDPGFTGGDLLALGRNSNTSLIVNFSKPQTYRIRIRYAASKTSYFQLRGLHNIAQSQRFEATYSNKNENDLTFNDFKYVEIQKTVSIDNPSESRSISIYTQSDTELLIIDKIEFIPVDATFEAEQDLDVAKKAVNGLFTNTKDALQTSVTGYQGNQAGKLSRMPIDELYPNEKRMLWDAVKEAKRLVQARNLLQDTGFNVINGENGWTGSTGIEVVEGDVLFKDRSLRLPSAREIDTETYPTYLYQQIDESLLKPYTRYRLRGFIGSSQDLEIKLIRHRANQIVKNVPDNLLPDVRPVNSCGGVDRCSEQQYVDANLALENNGENRNMSSDSHAFSFHMDTGEIDLNENTGIWVVFKIPTTNGYATLGNLELVEEGPLSGDALERLQREEQQWKLQRTKRREETDRKYMAAKQAIDRLFADYQDQQLNSGVEMSDLLAAQNLVQSIPYVYNEMFPEIPGMNYTNFTELTNRLQQAWNLYDLRNAIPNGDFRNGLSDWNATSDINVQQLNDTSVLVIPNWNSQVSQQFTVQPNYRYVLRVTARKEGAGDGYVIIRDGTNQTETLAFNTCDNDAGVLSTNQASYITKTVEFTPSTEQVWIDMSETEGVFNIESVELVLEEE

SEQ ID NO: 489 - protein, 1157 aa, Bacillus thuringiensis 145
MSPNNQNEYEIIDASSPTSVSNNSVKYPLASDQTTTLQNMNYKDYLRMSEGENPELFGNPETFISAQDAVGTGIDIVSKLLGSLGVPLVGQAATALKWIIGKLWPSSGNPWDDLMTAVEELINQKIEAYARSKALAELGVSGRAVKSYQTALEEWQKNPNNARSAALVRERFSDAEHTLRTQMSLFTVRGYEIPLLATYAQAANLHLFVMKDIQIYGREWGYTQGDINLFYREQVEFTGEYSDYCVKWYNAGLDKLRGSTALQWINYNRFRREMTVMALDIVALFPNYDIRMYPMKTTAELTRRIYTDPLGYTGSGSNTPPWYNYGYSFSWIENNAMPAPGLFQWLQGIGIYTKFARITPFYANYWSGHTVFYKFTNDSTERRVQYGDTDTPELDSSSFENVDIYKVSASVGSYKSNTVLLPTFKATFEGVNQNNQLKTFRYQKESNVPSQTKNSTTELPVQLSTPPTYGDSEQYSHRLAYVFDAPIDSYTGIYRMYGFAPILGWTHISVSRDNRIDPDKITQIPAVKAYAEGLANYIKDPGFTGGDLLALGRNSNTSLIVNFSKPQTYRIRIRYAASKTSYFQLRGLHNIAQSQRFEATYSNKNENDLTFNDFKYVEIQKTVSIDNPSESRSISIYTQSDTELLIIDKIEFIPVDATFEAEQDLDVAKKAVNGLFTNTKDALQTSVTDYQVNQAANLVECLSDELYPNEKRMLWDAVKEAKRLVQARNLLQDTGFNVINGENGWTGSTGIEVVEGDVLFKDRSLRLPSAREIDTETYPTYLYQQIDESLLKPYTRYRLRGFIGSSQDLEIKLIRHRANQIVKNVPDNLLPDVRPVNSCGGVDRCSEQQYVDANLALENNGENRNMSSDSHAFSFHMDTGEIDLNENTGIWVVFKIPTTNGYATLGNLELVEEGPLSGDALERLQREEQQWKLQRTKRREETDRKYMAAKQAIDRLFADYQDQQLNSGVEMSDLLAAQNLVQSIPYVYNEMFPEIPGMNYTNFTELTNRLQQAWNLYDLRNAIPNGDFRNGLSDWNATSDINVQQLNDTSVLVIPNWNSQVSQQFTVQPNYRYVLRVTARKEGAGDGYVIIRDGTNQTETLAFNTCDNDAGVLSTNQASYITKTVEFTPSTEQVWIDMSETEGVFNIESVELVLEEE

SEQ ID NO: 490 - protein, 1157 aa, Bacillus thuringiensis FCD114; identical to SEQ ID NO: 489

SEQ ID NO: 491 - protein, 1199 aa, Bacillus thuringiensis 185
MSPNNQNEYEIIDTPSRTSVSNDSVRYPFASDPTTDLNNMNYKDFLKTVNGYNTGDLSGSEAFISQTAINTAGKAVGTVLGLLGVPLAGAVGPLISFYGAVALLFWGPGDPWQAFMTQVEALVNQKIADYARNKAIAELQGLRNILDLYRLALIEWEENPTRTRSLTNIRLKFEDVNQFFEYQMPSFAVGGYEVPLLAVYAQAANLHLSVLRDAAIFGEQWGMSQTAINNIYDLQQRRTAEYINHCVKWYNNGLDKLRGSNAGQWVNFNRYRREMTLMVLDIVAIFPNYDTRTYPSGIGTSVQLTREVYTDPIGATSTQGGVSWYDDAPSFTAIESSVVRPLHLFDLLTGVTVYAASSSWDSSHYFRFWNGHKVDTKGIKSSVQYSNVYGSTSNAVSTTIIPFSGFDVYRVFSLAGVLFAWTTRYFGAPEVYFQRVDHNSGIDVGYDIAFSERYAGIGEQQKDSLDELPLQTEGPAYRSYSHRLNHISMVPQTVRTRNVPVFSWSHRSADIDNRIFQDRINQIPVVKGHTLGPGASVMAGPGFTGGNIVTRTSPGVVVFSGVTIKNALSQRYRVRIRYASTTDFRFFSTLSGTRLYATQATKTMNKGQQLTYESFQYATIGSTFTFENVNDSLTIGADQFLSGEQVYVDRYEVIPVDATFEAENDLEVAKKAVNNLFTNAKDALQTDVTDYQVNQAANLVECLSSELYPNEKRLLFDAVKEAKRLDQARNLLQDTQFNEMNGENGWNGSTGVEIVEDDVFFKDRSIRLSSAREAGTENSPTYLYQKIDESRLKPYTRYSLRGFVRSSQNLEIYVTRYQTQRVVKNIVDNFLPDMYAVNACGGIDRCGEQKHVNTMLGLENNVPNGNTVSDSHEFSIPVDTGELNYNEDTGIWVVFKITTTDGYATLGNLELVEEGPLSGETLERVKNQGKQWQDQMARRRAETDTRYGTAKQAIDRLFVDYQDQQLSPSIEISDLTAAQNLVQSIPYVYNDTLPEIPGMNYTSVTELTNRLQQAWNLYDLRNSIQNGDFRNDVSNWNVTPGVNIQQMNHTSVLVIPNWDSQASQQITVQPNRRYVLRVTARKEGSGDGYVTIRDGAKYTETLTFNTCDYNGSSVYQEQALYTNDVYNTQSVNIQGSNSAYHTQATNTDRYNMNGMYNDQTSYVTKTVEFIPYTEQVWIEMSETEGVFYIESVELIVEEM

SEQ ID NO: 492 - protein, 1194 aa, Bacillus thuringiensis su4
MSPNNQNEFDIIDVPSNISVSNSFVRYPFANDPNRTLQNTNYKDFLTMSEKSNSGYLTDPEAFDDVGSAIFAGLSITAKIMDAFDVPGGDIFNGLLEIIGILWDLQDDTWEAFMEQVEVLIDQKIAEYARNLALTNLKGLENSYKLYLEALADWKQNPTSPSSQERVRTRFRDTDDSLTVFMPSFAVKGYEVPLLAVYAQAANLHLLLLRDSVAYGLGWGLSQLNVNDNYNRQVRLTGEYTNHCVSWYTTGLEKLRGSNAQSWIKFNRYRREMTVMVLDIVALFPNYDARRYPQATTTELTRLIYTDPHGYTIYSPTSQTTIPWYEYGQSFSEIENVAIQAPRLFRWAQEMQIYTKFVRHAPQESHYWSAHTFSFHHTRDNTKTTLTYGDTSDPISVGTADLSDLDIYKVSSLVASSWGSGVRLLVTKAKFEVIYTFNQLWEFNYEPPGISNFFNQWKNTDTELPIQIVDPPTFGDPNQYSHRVAYISHAPIQPYSGAFRNYGLVPVFGWSHVSVDRNNTLYADRITQIPAVKAVQLSGEPYPVVRGPGFTGGDIARLPNNPNVGLLFNSKVESPSENKRYRVRIRYACASGARAIFGGLYLPITVQFNQTMSTTTPTRYEDFQYVDVSGSFILGNTNVSFSLVPQSANQTNNLFIDKIEFIPENPALEAESDLEAAKKAVNALFTNSKDTLQIGVTDYQINQAANLIECVSDEVYPNEKRLLFDAVKEAKRLSTARNLLEDTDFHTINGGNGWTGSTGIEIVEGDILFKDRSLRLPSAREIERETYPTYIYQKIEESRLKPNTRYSLRGFIGSSQDLEIYVLRHQAYRVIKNVSDNLLPNMRPINACGGVDRCSQQKYVNNSLEVNSGLSNGIGAADSHEFSIHVDTGELNYNEDMGIGVVFKITTTDGYATVGNIELVEVETLSGEALERVQRQEKQWQGQLATRRKETETRYGPAKQAIDRLFVDFQDQQLSRSTEISDLTEAQNLVQSIPYVYNDMLPEIPGMNYTSVTELTNRLQQAWNLYDQRNSIQNGDFRNDVSNWNVTTEVNIQQMNDTSVLVIPNWDSQVSQQITVQPNRRYVLRVTARKEGNGDGYVTIRDGANHTETLTFNTCDYDGNSVYNNQPLNANNNVYTTKSSNTNSYHTNGVYHDQTSYVTKTMEFTPYTEQVWVEMSETEGVFYIDSVELIVEEM

SEQ ID NO: 493 - protein, 1162 aa, Bacillus thuringiensis FPT-2
MSPNNQNEYEIIDMAPSTSVSNDSNRYPFASDPTNALQNMNYKEYLRMSEGYDSEYSGSPEVLISERDAVKTAISLVGTILGKLGVPLVGPIVSLYSTLIDVLWPGGKSQWEIFMEQVEALINQKIAEYARAKALAELEGLGNNYQLYLTALEEWQENPSSTRVLRDVRNRFEILDSLFTQYMPSFRVTGYEVPLLSVYAQAANLHLLLLKDASIFGEEWGFSTTAINNYYNRQMSLIAQYSDHCVQWYRTGLDRLKGSNAKQWVEYNRFRREMTLSVLDIMTLFPMYDMRTYPMETKAQLTREVYTDPIGAIGAQGSWYDSAPSFNTLESTFIRGKHLFDFITRLSIYTGRSSFSASNYLKKWIGHQISSQPIGGSIQTQTYGTTSGSSVIATQQIGFTGFDVYKTLSTAGVLFAYTSKYYGVSKVVFDAIYPDNKYKTTFTYNPGSEGIGAQEKDSEVELPPETLDQPNYEAYSHRLNYVTFIRNPDVPVFSWTHRSADRTASRNNFIYATKISQIPINKASRTSGGAVWNFQEGLYNGGPVMKLSGSGSQVINLRVATDAKGASQRYRIRIRYASDRAGKFTISSRSPENPATYSASIAYTNTMSTNASLTYSTFAYAESGPINLGISGSSRTFDISITKEAGAANLYIDRIEFIPVNTLFEAEEDLDVAKKAVNGLFTNEKDALQTSVTDYQVNQAANLIECLSDELYPNEKRMLWDAVKEAKRLVQARNLLQDTGFNRINGENGWTGSTGIEVVEGDVLFKDRSLRLTNAREIDTETYPTYLYQQIDESLLKPCTRYKLKGFIGSSQDLEIKLIRHRANQIVKNVPDNLLPDVRPVNSCGGVDRCSEQQYVDANLALENNGENGNMSFDSHAFSFHIDTGEIDLNENTGIWIVFKIPTTNGNATLGNLEFVEEGPLSGETLEWAQQQEQQWQDKMARKRAASEKTYYAAKQAIDRLFADYQDQKLNSGVEMSDLLAAQNLVQSIPYVYNDALPEIPGMNYTSFTELTNRLQQAWNLYDLQNAIPNGDFRNGLSNWNATSDVNVQQLSDTSVLVIPNWNSQVSQQFTVQPNYRYVLCVTARKEGVGDGYVIIRDGANQTETLTFNICDDDTGVLSTDQTSYITKTVEFTPSTEQVWIDMSETEGVFNIESVELVLEEE

SEQ ID NO: 494 - protein, 903 aa, Bacillus thuringiensis
MSPNNLNEYEIIDATPSTSVSNDSTRYPYANEPTNALQNMNYKDYLRMSEGYDNKYFANPEVFAAPGGITTGITIVTKLLGWLGLPFAGETGMALNFILGLLWPTSGNPWAELMILVEELINQKIEETVRNKALADLGNSGRALRSYLNAFEDWQKNPNIFRSKELVKERFSNAEHSLRTEMSSFAIRGFEIPLLATYAQAANLHLFLIKDIQIYGKEWGYTQADIDLFYREQVEFTKEYTEHCINIYNDGLNQLKGSNAKQWIAFNRFRREMTLTVLDVVALFPNYDVRMYPIKTTTELTRTIYTDPLGYTKTGSSSTPPWYNYGSSFSYIESVAIPAPSLVKWLSQIEIYSKSARATPQSADYWAGHTITYHYSGDDGQAVPNYGDRTNPVIVNRYNFEQADIYRVSSSVASSTTSGVKLLTTKAIFDGISTNNGLVSYMYEKLSNFFNELKDTITELPVQISSPPTYGDAEQYSHRLSYVSNAPTEYSSGGHLILGLIPVLGWTHTSLTQTNQIHSDSITQIPAVKANSVSSYVTVEKGTGFTGGDLVKFSTGFMSTGIQFNLKIEERKRYRIRIRYAADVNATLSALGLNDAFINIKSTMSQDTPLKYNDFQYAEADKTVHLYNPRFSLYLENSDQSGKSIYIDRIEFIPVDETYEAEQDLENAKKAVNALFTNTKDGLRPGVTDYEVNQAANLVECLSDDLYPNEKRLLFDAVREAKRLSEARNLLQDPDFQEINGENGWTASTGIEVVEGDALFKGRYLRLPGARQIDTETYPTYLYQKIDEGVLKPYTRYRLRGFVGRSQGLEIYTIRHQTNRIVKNVPDNLLPDASPGNAGDGINRCSEQKYVNSRLEGEKGLPNGSRSAEAHEFSIPIDTGEIDYNENAGIWVGFKITDPEQKQ

SEQ ID NO: 495 - protein, 1173 aa, Bacillus thuringiensis kenyae
MSPNNQNEYEIIDATPSTSVSNDSTRYPYANEPTNALQNMNYKDYLRMSEGYDNKYFANPEVFAAPGGITTGITIVTKLLGWLGLPFAGETGMALNFILGLLWPTSGNPWAELMILVEELINQKIEEAVRNKALADLANSGRALQSYLNAFEDWQKNPNIFRSKELVRERFANAEHSLRTEMSSFAIRGFEIPLLATYAQAANLHLFLIKDVQIYGKEWGYTQADIDLFYREQVEFTKEYTEHCINIYNDGLNQLKGSNAKQWIAFNRFRREMTLTVLDVVALFPNYDVRMYPIKTTTELTRTIYTDPLGYTKTGSSSTPPWYNYGSSFSYIESVAIPAPSLVKWLSQIEIYSKSARATPQSADYWAGHTITYHYSGNNDQVVANYGDRTNPVIVNRYNFEQADIYRVSSSVASSTTSGVKLLTTKAIFDGISTNNGLVSYMYEKLSNFFNELKDTITELPVQVSSSPTYGDAEQYSHRLSYVSNAPTEYSSGGHLILGLIPVLGWTHTSLTQTNQIHSDSITQIPAVKANSVSSYVTVEKGTGFTGGDLVKFSTGFMSTGIQFNLKIEERKRYRIRIRYAADVNARLSANHFGTTFINIKSTMSQDTPLKYNDFQYAETDGTLTLQDSHFSLFLEDSDQSGKSIYIDRIEFIPVDETYEAEQDLENAKKAVNALFTNTKDGLRPGVTDYEVNQAANLVECLSDDLYPNEKRLLFDAVREAKRLSEARNLLQDPDFQEINGENGWTASTGIEVVEGDALFKGRYLRLPGARQIDTETYPTYLYQKIDEGVLKPYTRYRLRGFVGRSQGLEIYTIRHQTNRIVKNVPDNLLPDASPGNAGDGINRCSEQKYVNSRLEGEKGLPNGSRSAEAHEFSIPIDTGEIDYNENAGIWVGFKITDPEGYATLGNLELVEEGPLSGDALERLQREEQQWKIQMTKRREETDRKYMIAKQAVDRLYADYQDQQLNPNVEITDITAAQNVIQSIPYVYNDAFPGLPGMNYTKFTELTDRLQQAWSLYDQRNAIPNGDFRNELSNWNTTAGVNVQQLNGTSVLVIPNWDAQVSQQFTVQPNQRYVLRVTARKEGVGNGYVSIRDGGNQTETLTFSASDYDTNGVYNIQASNTNGYNTNGVYNDQTGYITKTAEFIPHTNQVWIEMSETEGTFYIESVELIVDVE

SEQ ID NO: 496 - protein, 1157 aa, Bacillus thuringiensis
MSPNNQNEYEIIDMAPSTSVTNDSNRYPFANEPTNALQNMNYKDYLRMSEGYSPEYLTSLSPYSQFGTVDKIISIISLLNSAAGIPGLDFFTGLLQFILDFFAPEDPWAELMELVEQLIDQKITVATREKALAELRGLINGYLVYQQSLESWLENPNATRASIVREQYVALELDFVTSISSFAIAGQEVPLLAVYAQAANLHLLLLRDVSIFGEEWGLTVNEVNTFYIRQMTYTTEYSDYCVRIYNTGLNKLKGSSASSWVDYNRFRREMNLLVLDIIALFPNYDVRRYPMDTTTELTRVVYTDPIVFDERKGVASTHSWTAIAPSFSSIESLTRRPGLFTWLDQLTIFSKRISQPSVFINSWAGHKISTFRTQKTDILINTTHGDTNNPIKEFVVDTKKVEDIYQTIAYPHAVANEVFYLFGVPKVDFNMVPAGGSANSAHTLIFSDSTGGRLESITKNSEAELPPTESLSDTPQPNQVTYSHRLDYATIIKANKSYGSGYIPLLGWTHRSVDRQQTIYPQKITQIPAVKAFSYTESFNVNVIAGPGFTGGDLISLGHLENIYMKLNVPNPQKFRVRIRYAASTTSYLQITGLSNLAQSDRFEQTYSNENENNLMFENFQYVELRNIFSVDAPLENHQVSIQNYQGNGFVIIDRIEFIPVNATYDAENEAVNTTFTEGRNALQKYVTDYKVDQVDILVDCISGDLYPNEKRELQLLVKYAKRLSYSRNLLLDPTFDSINSSEENGWYGSNGIVIGNGDFVQKGNYLIFSGTNDTQYPTYLYQKIDESKLKEYSRYKLKGFIESSQDLEAYVRRYDAKHRTLDVSDNLLPDILPENTCGEPSRCAAQQYLDENPSSECSSMQDGILSDSHSFSLNIDTGSGNHNENLGIWVLFKISTLEGYAKFGNLEVIEDGPVIGEALARVKRQTTKWRNKLAQMTTETQAIYTRAKQALLNLFANAQDSHLKIDVTFAEIAAARKIVQSIREVYMSWLSVVPGVNHPIMTELSGRVQRAFQLYDVRNVVRNGRFLNGLSDWIVTSDVNVQEENGNMVLVLNNWDAQVLRNVKLYQDRGYVLRVTARKIGIEEGYITITDEEGHTDQLRFTACEEIDASNYFISGYITKELEFFPDTEKVHIEIGETEGEFLVESIELFLMEELC

SEQ ID NO: 497 - protein, 1121 aa, BGSC 4CC1
MEGGNNQGFINIEGRLSLEQVLAVSAGVASYILSNLGPFGVFFSYIIGAFWPTAPSDTRVWEAFMELIEARIDQKIQESTRKDAIARLQGLGAASEVYQESLESWLENQNDARAMSVVRQQFVAFELDFVTAMPFFERSGDEILLLAVYAQAANLHLLLLRDASLYGADWGMEPYDIANYYNRQKERTATYSNHCMEWYKKGLDELWSAGGYGGDVWQDYNDFRREMTLSVLDFVALFPNYDTHLYPIEVKGELTREIYTPGINIDIDRGRLGKVTLENALVNSPRLFSWLKEIQLFTNINFNPRWKFLSATRIGYKLTGYRSVNFEPYEGFYFEGLFQSNFTLNDYQEIYIVDVTRFGSLYDTPTAITAMTFFKDDNTTFNYSSNTPSGEPMITSGFYLPGIDGSEEPTSNNFSHRLSTINTYNTTNQTFYHTFGWTHVSVDRNNTIVSNKITQIPFVKANTGNVVRGPGHTGGDLVVFKPAARPDIVLRVGNTRLQSYRVRVRYASNADISLELDTTYEKTNIHLQKTFNSSEAEDLTYDNFQYAEADNIVWLGQDLSQYIEFQNAITNDSTAIAYFERVEFLPVGATYEAEQDLETAKKVVNALFTNTKNALQMSVTDYEVTQAANLVECVSDELFPNEKRLLFDAVKEAKRLSGIRNLLQDSDFQEINGENGWVGSIEIEIREGDTLFKGYSLRLPSAREIYMEMFPTYLHQKIEESRLKPYTRYRLRGFVSSSQDLEIFSIRHETNRIVKNVSDDLLPNLSSYYTCGGVNRCSTQKYVYNRLEFQNSLSSGNRYSDAHSFSIPIDTGKIDLNDNTGIWIAFKLATTGGYATLGNLELVEEAPLIGDTLERVQREDQQWKSQMTRKREEAERKYMAAKQAIDRLYADYQDHQLNPNVEITDITATQHLVQSLPYVNNDVLQEIPGMNYTRFTELTNRLQQAWELYGLRNMIANGDFRNGLNDWDATSGVNIQQINHTSVLVISNWDAQISKQFTVQPNQKYVLRVTVRKEGSGDGYVTIRDGGNHTETLTFNTCDYERSNVYNEKVFQSNDYGTNNVYHTQTTNANRYTTNSLYNDGTGYVTKTVEFIPYTEQVWIEMSETEGVFYVESIEFILEEV

SEQ ID NO: 498 - protein, 1173 aa, BtQ52-7
MSPNNQNEYEIIDASSPTSVSNNSVKYPLASDQTTTLQNMNYKDYLRMTERENPELSRNPETFISAQDAVGTGIDIVSTIISGVGIPVVGEVLSILGAILGLFWPSSGEDVWELFMERVEELIDQKIGTFAKDTAISNLGKSRIAVTSYRNALEAWQKNPNNARSISLVRERFADAEHTLRTNMSSFVISGYQIPFLATYAQAANLHLLVMKDVQIYGIQWGYTQGEIDLFYREQADFTAQYSDYCVKWYNAGLDKLRGTSAQQWVNYDRFRREMTVMALDIVALFPNYDVRMYPMQTNAELTREIYTPVGTFVTEAGSSFRRVISWHDMSTPNFPSFSTIENIVVRAPHMFRVLRELEISSMRRNNGSIEFYNYWSGQMTGHSNINNYSKISRVSGGDLTNDTTNVPLNNRNIYRAIWNYIGRVENSLLGVNPVDFFFTNNTRFTYNRPRSILWGGAGELRIDSGEELPFKSHTDYSHIVSSASSFPLFSNFGTRLGSVVTFGWTHSSVDLENTIHPDKITQIPAVKAFASSVTAEAVKGVGNTGGNLVRLYSGGLYTAITMRFKVAERKQYRVRIRYAANVNATLSLRNYTSTTNYTSTTINLTSTMNEKEPSSYNDFRYVEATRVISLNNHTEFRMIEESSSQIGGYIYIDKIEFIPVDATYEAEQDLDVAKKAVNGLFTNTKDALQTSITDYQVNQAANLVECLSDELYPNEKRMLWHAVKEAKRLVQARNLLQDTGFNVINGENGWTGSTGIEVVEGDVLFKDRSLRLPSAREIDTETYPTYLYQQIDESLLKPYTRYRLRGFIGSSQDLEIKLIRHRANQIVKNVPDNLLPDVRPVNSCGGVDRCSEQQYVDANLALENNGENRNMSSDSHAFSFHMDTGEIDLNENTGIWVVFKIPTTNGYATLGNLELVEEGPLSGEVLERAQQQEQQWQDKMVRKRTASEKANYAAKQAIDRLFADYQDQQLNSGVEMSDLLAAQNLIQSIPYVYNEMLPEIPGMNYTNFTELTNRLQQAWNLYDLRNAIPNGDFRNGLSDWNATSDINVQQLNDTSILVIPNWNSQVSQQFTVQPNYRYVLRVTARKEGVGDGYVSIRDGGNQTETLTFSASDYNTPASNTNGYNTNGVYNDQTGYITKTVTFIPYTDQVWIEMSETEGVFNIESVELVLEEE

SEQ ID NO: 499 - protein, 1204 aa, Bacillus thuringiensis R36
MSPNNQNEYEIIDTPSRTSVSNDSVRYPFANEPTTDLNNMNYKDYLRMSEVDDATFLSNPEAFIDSKSVQTIIGIVGKGLGVLGVPGAAAIAQFFSFLVGQLWPSTGEFIWEQIIEQVEALVDQKITDYARNKALSEVQGLGEAFAVYQQSLQTWQENRTDSRVRGVIIQQFIALDLDFVNKMPSFAVSGQEVPLLAVYALAANIHLLLLRDASLFGAEWGFATPEISDYYNRQIQLITKYTDYCVNWYNTGLGYMRKVDSTGSGNRQTRNWLRYHQFRREMTLMVLDVLALFPGYDIRTYPGNVHFQLTREVYTDPIVFNPSSKPSGKFCDPWESRYEYDYLSEMENVLVRPPHLFEIFVNNTYFTGRGTILFNDNEYINYMIGNKITYRYTNDDTRYERNYGSSSTETNSLIFGLSDEFDIFNISSVAANLANYYGNRYGFPYARWYCGSGLGGSGYNTFTYSRTHTTNQICTQSYDAQNELPPEGSQSQADYSHRLAHIASYTIPVKSGGGISGNIPLYAWTHRSASKFNYITPNRINHLPMVKSYILPTGTSVVQGPGFTGGNLLKRATSGQIAKLKVELINFGLSAQYRVRIRYASTSTLNFRVFQTGTLVNDLNFNRTMSRGESLTHNKFKFASFTTPFMFTSKFSELRIDVSNLSSGEEVYVDSIEVIPVNATYEAETNLEVAKKAVMSCLRMQRALQTDVTDYQVNQVANLIECVSDEVYPNEKRLLFDAVKEAKRLDQARNLLQDPNFQEINGENGWTGSTGIEIVEGDLPFKDRSLRLPSAREMERETYPTYIYQKIEESRLKPNTRYKFRGFIGSSQDLEIYVIRHQAYRVIKNVSNNLLPNMRPINACGGVDRCNEQKQVNTVLGLENNVPNGNTMSDSHEFSIPVDTGELNYNENPGIWVVFKITTTDGYATVGNIELVEEETLSGEALERVQQQEKRWQDQMARRRAETENRYGIAKQAIDRLFVDYSKVSSSIEISDLTAAQNLVQSIPYVYNEMLPEIPGMNYTSVTELTNRLQQAWNLYDQRNSIQNGDFRNDVRNWNVTPGVNIQQMNDTSVLVIPNWDSQVSQQITVQPNRRYVLRVTARKEGNGDGYVTIRDGANHTETLTFNTCDYDGSSVYDNQAFNANNDVYTTQSSNTNRYNTNGVYHDQTSYITKTVEFIPYTEQVWIEMSETEGVFYVESVELIVEEM

SEQ ID NO: 500 - protein, 802 aa, Bacillus thuringiensis
MNQNKHGIIGASNCGCASDDVAKYPLANNPYSSALNLNSCQNSSILNWINIIGDAAKEAVSIGTTIVSLITAPSLTGLISIVYDLIGKVLGGSSGQSISDLSICDLLSIIDLRVSQSVLNDGIADFNGSVLLYRNYLEALDSWNKNPNSASAEELRTRFRIADSEFDRILTRGSLTNGGSLARQNAQILLLPSFASAAFFHLLLLRDATRYGTNWGLYNATPFINYQSKLVELIELYTDYCVHWDNRGSTELRQRGPSATAWLEFHRYRREMTLMGLEIVASFSSLDITNYPIETDFQLSRVIYTDPIGFVHRSSLRGESWFSFVNRANFSDLENAIPNPRPSWFLNNMIISTGSLTLPVSPSTDRARVWYGSRDRISPANSQFITELISGQHTTATQTILGRNIFRVDSQACNLNDTTYGVNRAVFYHDASEGSQRSVYEGYIRTTGIDNPRVQNINTYLPGENSDIPTPEDYTHILSTTINLTGGLRQVASNRRSSLVMYGWTHKSLARNNTINPDRITQIPLTKVDTRGTGVSYVNDPGFIGGALLQRTDHGSLGVLRVQFPLHLRQQYRIRVRYASTTNIRLSVNGSFGTISQNLPSTMRLGEDLRYGSFAIREFNTSIRPTASPDQIRLTIEPSFIRQEVYVDRIEFIPVNPTREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRAIQLASARENYPTYIYQKVDASELKPYTRYRLDGFVK

SEQ ID NO: 501 - protein, 1156 aa, Bacillus thuringiensis galleriae
MNQNKHGIIGASNCGCASDDVAKYPLANNPYSSALNLNSCQNSSILNWINIIGDAAKEAVSIGTTIVSLITAPSLTGLISIVYDLIGKVLGGSSGQSISDLSICDLLSIIDLRVSQSVLNDGIADFNGSVLLYRNYLEALDSWNKNPNSASAEELRTRFRIADSEFDRILTRGSLTNGGSLARQNAQILLLPSFASAAFFHLLLLRDATRYGTNWGLYNATPFINYQSKLVELIELYTDYCVHWYNRGFNELRQRGTSATAWLEFHRYRREMTLMVLDIVASFSSLDITNYPIETDFQLSRVIYTDPIGFVHRSSLRGESWFSFVNRANFSDLENAIPNPRPSWFLNNMIISTGSLTLPVSPSTDRARVWYGSRDRISPANSQFITELISGQHTTATQTILGRNIFRVDSQACNLNDTTYGVNRAVFYHDASEGSQRSVYEGYIRTTGIDNPRVQNINTYLPGENSDIPTPEDYTHILSTTINLTGGLRQVASNRRSSLVMYGWTHKSLARNNTINPDRITQIPLTKVDTRGTGVSYVNDPGFIGGALLQRTDHGSLGVLRVQFPLHLRQQYRIRVRYASTTNIRLSVNGSFGTISQNLPSTMRLGEDLRYGSFAIREFNTSIRPTASPDQIRLTIEPSFIRQEVYVDRIEFIPVNPTREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRAIQLASARENYPTYIYQKVDASELKPYTRYRLDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDDAHHTETLTFNACDYDINGTYVTDNTYLTKEVVFHPETQHMWVEVNETEGAFHIDSIEFVETEK

SEQ ID NO: 502 - protein, 1151 aa, Bacillus thuringiensis DSIR517
MNQNKHGIIGASNCGCASDDVAKYPLANNPYSSALNLNSCQNSSILNWINIIGDAAKEAVSIGTTIVSLITAPSLTGLISIVYDLIGKVLGGSSGQSISDLSICDLLSIIDLRVSQSVLNDGIADFNGSVLLYRNYLEALDSWNKNPNSASAEELRTRFRIADSEFDRILTRGSLTNGGSLARQNAQILLLPSFASAAFFHLLLLRDATRYGTNWGLYNATPFINYQSKLVELIELYTDYCVHWYNRGFNELRQRGTSATAWLEFHRYRREMTLMVLDIVASFSSLDITNYPIETDFQLSRVIYTDPIGFVHRSSLRGESWFSFVNRANFSDLENAIPNPRPSWFLNNMIISTGSLTLPVSPSTDRARVWYGSRDRISPANSQFITELISGQHTTATQTILGRNIFRVDSQACNLNDTTYGVNRAVFYHDASEGSQRSVYEGYIRTTGIDNPRVQNINTYLPGENSDIPTPEDYTHILSTTINLTGGLRQVASNRRSSLVMYGWTHKSLARNNTINPDRITQIPLTKVDTRGTGVSYVNDPGFIGGALLQRTDHGSLGVLRVQFPLHLRQQYRIRVRYASTTNIRLSVNGSFGTISQNLPSTMRLGEDLRYGSFAIREFNTSIRPTASPDQIRLTIEPSFIRQEVYVDRIEFIPVNPTREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRAIQLASARENYPTYIYQKVDASELKPYTRYRLDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDDAHHTETLTFNACDYDINGTYVTDNTYLTKEVVFHPETQHMWVEVNETEGAFHIDSIEF

SEQ ID NO: 503 - protein, 1144 aa, Bacillus thuringiensis galleriae
VFELKTCIWHAFFLTKLSSYKDYLKMSEGDYIDSYINPGNVRTGLQTGIDIVAVVVGALGGPVGGILTGFLSTLFGFLWPSNDQAVWEAFIEQMEELIEQRISDQVVRTALDDLTGIQNYYNQYLIALKEWEERPNGVRANLVLQRFEILHALFVSSMPSFGSGPGSQRFQAQLLVVYAQAANLHLLLLADAEKYGARWGLRESQIGNLYFNELQTRTRDYTNHCVNAYNNGLAGLRGTSAESWLKYHQFRREATLMAMDLIALFPYYNTRRYPIAVNPQLTREVYTDPLGVPSEESSLFPELRCLRWQETSAMTFSNLENAIISSPHLFDTINNLMIYTGSFSVHLTNQLIEGWIGHSVTSSLLASGPTTVLRRNYGSTTSIVNYFSFNDRDVYQINTRSHTGLGFQNAPLFGITRAQFYPGGTYSVTQRNALTCEQNYNSIDELPSLDPNEPISRSYSHRLSHITSYLHRVLTIDGINIYSGNLPTYVWTHRDVDLTNTITADRITQLPLVKSFEIPAGTTVVRGPGFTGGDILRRTGVGTFGTIRVRTTAPLTQRYRIRFRFASTTNLFIGIRVGDRQVNYFDFGRTMNRGDELRYESFATREFTTDFNFRQPQELISVFANAFSAGQEVYFDRIEIIPVNPAREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRALQLASARENYPTYIYQKVDASELKPYTRYRSDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDGAHHTETLTFNACDYDINGTYVTDNTYLTKEVIFYSHTEHMWVEVNETEGAFHIDSIEFVETEK

SEQ ID NO: 504 - protein, 1164 aa, Bacillus thuringiensis B-SC5
MNRNNQNEYEVIDTSTCGCPSGDVMQYPLANDPNAALQNMNYKEYLQMSEGDYIDSYINPGNVRTGLQTGIDIVAVVVGALGGPVGGILTGFLSTLFGFLWPSNDQAVWEAFIEQMEELIEQRISDQVVRTALDDLTGIQNYYNQYLIALKEWEERPNGVRANLVLQRFEILHALFVSSMPSFGSGPGSQRFQAQLLVVYAQAANLHLLLLADAEKYGARWGLRESQIELYFNELQTRTRDYTNHCVNAYNNGLAGLRGTSAESWLKYHQFRREATLMAMDLIALFPYYNTRRYPIAVNPQLTREVYTDPLGVPSEESSLFPELRCLRWQETSAMTFSNLENAIIRPPHLFDTINNLMIYTGSFRFTNNQLIEGWIGHSVTSSLLASGPTTVVRRNYGSTTSIVNYFSFNDRDVYQINTRSHTGLGFQNAPLFGITRAQFYPGGTYSVTQRNALTCEQNYNSIDELPSLDPNEPISRSYSHRLSHITSYLHRVLTIDGINIYSGNLPTYVWTHRDVDLTNTITADRITQLPLVKSFEIPAGTTVVRGPGFTGGDILRRTGVGTFGTIRVRTTAPLTQRYRIRFRFASTTNLFIGIRVGDRQVNYFDFGRTMNRGDELRYESFATREFTTDFNFRQPQELISVFANAFSAGQEVYFDRIEIIPVNPAREAKEDLEAAKKAVASLFTRTRDGLQVNVKDYQVDQAANLVSCLSDEQYGYDKKMLLEAVRAAKRLSRERNLLQDPDFNTINSTEENGWKASNGVTISEGGPFYKGRALQLASARENYPTYIYQKVDASELKPYTRYRLDGFVKSSQDLEIDLIHHHKVHLVKNVPDNLVSDTYPDDSCSGINRCQEQQMVNAQLETEHHHPMDCCEAAQTHEFSSYIDTGDLNSSVDQGIWAIFKVRTTDGYATLGNLELVEVGPLSGESLEREQRDNTKWSAELGRKRAETDRVYQDAKQSINHLFVDYQDQQLNPEIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDGAHHTETLTFNACDYDINGTYVTDNTYLTKEVIFYSHTEHMWVEVNETEGAFHIDSIEFVETEK

SEQ ID NO: 505 - protein, 1163 aa, Bacillus thuringiensis japonensis
MNRNNQNEYEVIDTSTCGCPSGDVMQYPLANDPNAALQNMNYKEYLQMYGGDYADAFINPGNVRTGLQTGIDIVALLVGTLGGAVGGILTGLLSTLFGFLWPSNDQAVWEAFIEQMEELIEQRISDQVVRTALDNLTGIQNYYNQYLLAFEEWEEAPNSVRSNLVLQRFENLHALFVSSMPSFGSGPGSQRFEAQLLLVYAQAANLHLLLLRDAEIYGARWGLRESQIQLYFDELQNNTRDYTNHCVNAYNNGLEQVRGTNAASWLKYHQFRRETTLTAMDLVALFPYYNLRQYPIAVNPQLTREVYTDPLGVPFEESNPSSEIRCSRWQDTSAMTFSNLENALVRPPHLFDTIRNLRIYTGTFRVNNNNFIEGWIGHSVTNNRLGISTEFTRNYGITTPIINSYNFANGDVYQINTRSNTSLIAFENAPLFGITRAQFQPGGTYSVTQRTLLCEQNYNSTDELPSLDPDEPISRSYSHRLSHITSYLHRVFTIDGNNIYSGNLPTYVWTHRDVDLTNTITADRITHLPLIKSNVQRSGLPVKGPGFTGGDVLRSSSSDADVSIIGVSAGAPLTQQYRIRVRYASNVDVTIRFVRHNTHSLLGIGTLSRTMNSGEESRYESYRTVDVITNFRLNSSSEQIRIVTEGLRANGQLYLDSLEFIPINPTREAEEDLEAAKKAVASLFTRTRDGLQANVTDYQVDRAANLVLCLSDEQYAHDKKMLLEAVRAAKRLSRERNLLQDPDFNEINSTEDSGWKTSNGIIISEGGPFFKGRALQLASARENYPTYIYQKVDSSMLKPYTRYKLDGFVQSSQDLEIELIHHHKVHLVKNVPDNLVLDTYPDGSCNGINRCEEQQMVNSQLETEHHPMDCCEASQTHEFSSYIHTGDLNASVDQGIWVVLKIRTTDGSATLGNLELVEVGPLSGESLEREQRDNAKWNAELGRKRAEADRVYQGAKQAINHLFVDYQDQQLNPEVGLAEISEARNLIESISDVYCDAVLRIPGINYEMYTELSNRLQQAAYLYTSRNAVQNGDFNSGLDSWNATTDATVQQDGNMYFLVLSHWDAQVSQQFRVQPNCKYVLRVTAKKVGNGDGYVTIQDGAHHRETLTFNACDYDVNGTHVNDNSYITKELEFYPKTEHMWVEVSETEGTFYIDSIELIETQE

SEQ ID NO: 506 - protein, 1157 aa, Bacillus thuringiensis tolworthi
MNRNNQNEYEIIDAPHCGCPSDDDVRYPLASDPNAALQNMNYKDYLQMTDEDYTDSYINPSLSISGRDAVQTALTVVGRILGALGVPFSGQIVSFYQFLLNTLWPVNDTAIWEAFMRQVEELVNQQITEFARNQALARLQGLGDSFNVYQRSLQNWLADRNDTRNLSVVRAQFIALDLDFVNAIPLFAVNGQQVPLLSVYAQAVNLHLLLLKDASLFGEGWGFTQGEISTYYDRQLELTAKYTNYCETWYNTGLDRLRGTNTESWLRYHQFRREMTLVVLDVVALFPYYDVRLYPTGSNPQLTREVYTDPIVFNPPANVGLCRRWGTNPYNTFSELENAFIRPPHLFDRLNSLTISSNRFPVSSNFMDYWSGHTLRRSYLNDSAVQEDSYGLITTTRATINPGVDGTNRIESTAVDFRSALIGIYGVNRASFVPGGLFNGTTSPANGGCRDLYDTNDELPPDESTGSSTHRLSHVTFFSFQTNQAGSIANAGSVPTYVWTRRDVDLNNTITPNRITQLPLVKASAPVSGTTVLKGPGFTGGGILRRTTNGTFGTLRVTVNSPLTQQYRLRVRFASTGNFSIRVLRGGVSIGDVRLGSTMNRGQELTYESFFTREFTTTGPFNPPFTFTQAQEILTVNAEGVSTGGEYYIDRIEIVPVNPAREAEEDLEAAKKAVASLFTRTRDGLQVNVTDYQVDQAANLVSCLSDEQYGHDKKMLLEAVRAAKRLSRERNLLQDPDFNTINSTEENGWKASNGVTISEGGPFFKGRALQLASARENYPTYIYQKVDASVLKPYTRYRLDGFVKSSQDLEIDLIHHHKVHLVKNVPDNLVSDTYSDGSCSGINRCDEQHQVDMQLDAEHHPMDCCEAAQTHEFSSYINTGDLNASVDQGIWVVLKVRTTDGYATLGNLELVEVGPLSGESLEREQRDNAKWNAELGRKRAEIDRVYLAAKQAINHLFVDYQDQQLNPEIGLAEINEASNLVESISGVYSDTLLQIPGINYEIYTELSDRLQQASYLYTSRNAVQNGDFNSGLDSWNTTMDASVQQDGNMHFLVLSHWDAQVSQQLRVNPNCKYVLRVTARKVGGGDGYVTIRDGAHHQETLTFNACDYDVNGTYVNDNSYITEEVVFYPETKHMWVEVSESEGSFYIDSIEFIETQE

SEQ ID NO: 507 - protein, 1156 aa, Bacillus thuringiensis
MNRNNQNEYEIIDAPHCGCPSDDDVRYPLASDPNAALQNMNYKDYLQMTDEDYTDSYINPSLSISGRDAVQTALTVVGRILGALGVPFSGQIVSFYQFLLNTLWPVNDTAIWEAFMRQVEELVNQQITEFARNQALARLQGLGDSFNVYQRSLQNWLADRNDTRNLSVVRAQFIALDLDFVNAIPLFAVNGQQVPLLSVYAQAVNLHLLLLKDASLFGEGWGFTQGEISTYYDRQLELTAKYTNYCETWYNTGLDRLRGTNTESWLRYHQFRREMTLVVLDVVALFPYYDVRLYPTGSNPQLTREVYTDPIVFNPPANVGLCRRWGTNPYNTFSELENAFIRPPHLFDRLNSLTISSNRFPVSSNFMDYWSGHTLRRSYLNDSAVQEDSYGLITTTRATINPGVDGTNRIESTAVDFRSALIGIYGVNRASFVPGGLFNGTTSPANGGCRDLYDTNDELPPDESTGSSTHRLSHVTFFSFQTNQAGSIANAGSVPTYVWTRRDVDLNNTITPNRITQLPLVKASAPVSGTTVLKGPGFTGGGILRRTTNGTFGTLRVTVNSPLTQRYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLEAAKKAVANLFTRTRDGLQVNVTDYQVDQAANLVSCLSDEQYGHDKKMLLEAVRAAKRLSRERNLLQDPDFNTINSTEENGWKASNGVTISEGGPFFKGRALQLASARENYPTYIYQKVDASVLKPYTRYRLDGFVKSSQDLEIDLIHHHKVHLVKNVPDNLVSDTYSDGSCSGINRCDEQHQVDMQLDAEHHPMDCCEAAQTHEFSSYINTGDLNASVDQGIWVVLKVRTTDGYATLGNLELVEVGPLSGESLEREQRDNAKWNAELGRKRAEIDRVYLAAKQAINHLFVDYQDQQLNPEIGLAEINEASNLVESISGVYSDTLLQIPGINYEIYTELSDRLQQASYLYTSRNAVQNGDFNSGLDSWNTTMDASVQQDGNMHFLVLSHWDAQVSQQLRVNPNCKYVLRVTARKVGGGDGYVTIRDGAHHQETLTFNACDYDVNGTYVNDNSYITEEVVFYPETKHMWVEVSESEGSFYIDSIEFIETQE

SEQ ID NO: 508 - protein, 1169 aa, Bacillus thuringiensis japonensis N141
MNRNNQNEYEVIDAPHCGCPADDVVKYPLTDDPNAGLQNMNYKEYLQTYGGDYTDPLINPNLSVSGKDVIQVGINIVGRLLSFFGFPFSSQWVTVYTYLLNSLWPDDENSVWDAFMERVEELIDQKISEAVKGRALDDLTGLQYNYNLYVEALDEWLNRPNGARASLVSQRFNILDSLFTQFMPSFGSGPGSQNYATILLPVYAQAANLHLLLLKDADIYGARWGLNQTQIDQFHSRQQSLTQTYTNHCVTAYNDGLAELRGTTAESWFKYNQYRREMTLTAMDLVALFPYYNLRQYPDGTNPQLTREVYTDPIAFDPLEQPTTQLCRSWYINPAFRNHLNFSVLENSLIRPPHLFERLSNLQILVNYQTNGSAWRGSRVRYHYLHSSIIQEKSYGLLSDPVGANINVQNNDIYQIISQVSNFASPVGSSYSVWDTNFYLSSGQVSGISGYTQQGIPAVCLQQRNSTDELPSLNPEGDIIRNYSHRLSHITQYRFQATQSGSPSTVSANLPTCVWTHRDVDLDNTITANQITQLPLVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPAREAEEDLEAAKKAARQNLFTRTRDGLQVNVTDYQVDQAANLVSCLSDEQYGHDKKMLLEAVRAAKRLSRERNLLQDPDFNTINSTEENGWKASNGVTISEGGPFFKGRALQLASARENYPTYIYQKVDASVLKPYTRYRLDGFVKSSQDLEIDLIHYHKVHLVKNVPDNLVSDTYSDGSCSGMNRCEEQQMVNAQLETEHHHPMDCCEAAQTHEFSSYINTGDLNASVDQGIWVVLKVRTTDGYATLGNLELVEVGPLSGESLEREQRDNAKWNAELGRKRAEIDRVYLAAKQAINHLFVDYQDQQLNPEIGLAEINEASNLVESISGVYSDTLLQIPGINYEIYTELSDRLQQASYLYTSRNAVQNGDFNSGLDSWNTTTDASVQQDGNMHFLVLSHWDAQVSQQLRVNPNCKYVLRVTARKVGGGDGYVTIRDGAHHQETLTFNACDYDVNGTYVNDNSYITEEVVFYPETKHMWVEVSESEGSFYIDSIEFIETQE

SEQ ID NO: 509 - protein, 645 aa, Bacillus thuringiensis japonensis
HCGCPADDVVKYPLTDDPNAGLQNMNYKEYLQTYGGDYTDPLINPNLSVSGKDVIQVGINIVGRLLSFFGFPFSSQWVTVYTYLLNSLWPDDENSVWDAFMERVEELIDQKISEAVKGRALDDLTGLQYNYNLYVEALDEWLNRPNGARASLVSQRFNILDSLFTQFMPSFGSGPGSQNYATILLPVYAQAANLHLLLLKDADIYGARWGLNQTQIDQFHSRQQSLTQTYTNHCVTAYNDGLAELRGTTAESWFKYNQYRREMTLTAMDLVALFPYYNLRQYPDGTNPQLTREVYTDPIAFDPLEQPTTQLCRSWYINPAFRNHLNFSVLENSLIRPPHLFERLSNLQILVNYQTNGSAWRGSRVRYHYLHSSIIQEKSYGLLSDPVGANINVQNNDIYQIISQVSNFASPVGSSYSVWDTNFYLSSGQVSGISGYTQQGIPAVCLQQRNSTDELPSLNPEGDIIRNYSHRLSHITQYRFQATQSGSPSTVSANLPTCVWTHRDVDLDNTITANQITQLPLVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLD

SEQ ID NO: 510 - protein, 1169 aa, Bacillus thuringiensis kurstaki DP1019
MNRNHQNEYEIIDAPHCGCPSDDVVKYPLTDDPNAGLQNMNYKEYLQMYGGDYTDPLINPNLSVSGKDVIQVGINIVGRLLSFFGFPFSSQWVTVYTYLLNSLWPDDENSVWDAFMKRIEELIDQKISEAVKGRALDELTGLQDNYNLYVEALDEWLNRPNGARASLVSQRFNILDSLFTQFMPSFGSGPGSQNYSTILLPVYAQAANLHLLLLKDADIYGARWGLNQTQIDQFHSRQQSLTRTYTNHCVTTYNDGLAELRGTSVESWLKYHQYRREMTVTAMDLVALFPYYNVRQYPNGANPQLTREVYTDPIVFNPPEPPSGAFCESFYNIRAARERLTFSQLENAIIRPPRLFERFQALGIYTGEARLNQNSAPTNYWIGHFIRNTRLGDSTTITTNYGTTNNRLTNFIPPTTSDVYQINSISSNLASALSTLFGVTRAQFHYGSGIIWSYVGQNNVLPQCHQNYNSIEELPNQSDEPTVRSYSHRLSHITSFNFSVQLNNPVISLGNMPVYVWTHRSVDLNNTITSDRITQLPAVKASTLGAGAIVVKGPGFTGGDVIRRTSVGDFGTIRVSVTGSLTQQYRIRFRYASTIDFDFFVIRGGTTINNFRFTHTMSSGEESRYESYRTVEFSTPFNFTQSQDIIRTSIQGLSGNGEVYLDRIEIIPVNPTREAEEDLEDAKKAVAGLFTRTRDGLQVNVTDYQVDRAANLVSCLSDEQYSHDKKMLMEAVRAAKRLSRERNLLQDPDFNEINSTEENGWKASNGIIISEGGPFFKGRVLQLASARENYPTYIYQKVDASVLKPYTRYRLDGFVKSSEDLEIDLVHQHKVHLVKNVPDNLVSDTYPDGSCRGVNRCDEQHQVDVQIDTEHHPMDCCEAAQTHEFSSYINTGDLNSSVDQGIWVVLKVRTADGYATLGNLELVEVGPLSGESLEREQRDNAKWNAELGRERAETDRVYLAAKQAINHLFVDYQDQQLNPEIGLAEINEASNLVESITGVYSDTVLQIPGISYEIYTELSDRLQQASYLYTSRNAVQNGDFDSGLDSWNATTDASVQQDGNMHFLVLSHWDAQVTQQLRVNPNCKYVLRVTARKVGGGDGYVTIRDGAHHRETLTFNACDYDVNGTYVNDNTYITKEVVFYPHTEHTWVEVSESEGAFYIDSIELIETQE

SEQ ID NO: 511 - protein, 1150 aa, Bacillus thuringiensis aizawai SSK-10
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 512 - protein, 1150 aa, Bacillus thuringiensis B-Hm-16; identical to SEQ ID NO: 511

SEQ ID NO: 513 - protein, 1150 aa, Bacillus thuringiensis lyA
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTDSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 514 - protein, 1150 aa, Bacillus thuringiensis ywc5-4
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLGGFVQSSQDLEIDLIHHHKVHLVKNVPDNLVSGTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 515 - protein, 1150 aa, Bacillus thuringiensis
MNRNNPNEYDIIDAPYCGCPSDDDVRYPLASDPDAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNTSPSISGQEVYVDKLEIVPINPTREAEEDLEDAKKAVASLFTRTRDGLQVNVTDYQVDQAANLVSCLSDEQSGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTHSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 516 - protein, 1150 aa, Bacillus thuringiensis 11
MNRNNPNEYEIIDAPYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDIRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWPGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSCLSDEQYGHDKKMLLEAVRAAKRLSRERNLLQDPDFNEINSTEENGWKASNGVTISEGGPFFKGRALQLASARENYPTYIYQKVDASTLKPYTRYKLDGFVQSSQDLEIDLIHHHKVHLVKNVPDNLVSDTYSDGSCSGINRCEEQHQVDVQLDAEDHPKDCCEAAQTHEFSSYIHTGDLNASVDQGIWVVLQVRTTDGYATLGNLELVEVGPLSGESLEREQRDNAKWNEEVGRKRAETDRIYQDAKRAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 517 - protein, 1150 aa, Bacillus thuringiensis 4
MNRNNPNEYEIIDASYCGCPSDDDVRYPLASDPNAAFQNMNYKEYLQTYDGDYTGSLINPNLSINPRDVLQTGINIVGRILGFLGVPFAGQLVTFYTFLLNQLWPTNDNAVWEAFMAQIEELIDQKISAQVVRNALDDLTGLHDYYEEYLAALEEWLERPNGARANLVTQRFENLHTAFVTRMPSFGTGPGSQRDAVALLTVYAQAANLHLLLLKDAEIYGARWGLQQGQINLYFNAQQERTRIYTNHCVETYNRGLEDVRGTNTESWLNYHRFRREMTLMAMDLVALFPFYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRITQLPWVKASEIGGGTTVVKGPGFTGGDILRRTDGGAVGTIRANVNAPLTQQYRIRLRYASTTSFVVNLFVNNSAAGFTLPSTMAQNGSLTYESFNTLEVTHTIRFSQSDTTLRLNIFPSISGQEVYVDKLEIVPINPTREAEEDLEDAKKAVASLFTRTRDGLQVNVTDYQVDQAANLVSWLSDEQYGHDKKMLLETVRAAKHLSRERNILLDPDFIEINSTEENGWKASNGVTIREGGPLFKGGALQLASARENYPTYIFQKVDASTLKPYTRYKLDGFVQSSQDLEIDLIHHHKVPLVKKVPDNLVFDTYFDGSCSGNNRCEGQHQVDVQLDAGGHPKGCCEAGQTHEFSSYIHTGDLNASVDQGIWVVLQVRTTDGYATLGNLELVEVGPLSGESLEREQRDNAKWNEEVGRKRAETDRIYQDAKQAINHLFVDYQDQQLSPEVGMADIIDAQNLIASISDVYSDAVLQIPGINYEMYTELSNRLQQASYLYTSRNVVQNGDFNSGLDSWNATTDTAVQQDGNMHFLVLSHWDAQVSQQFRVQPNCKYVLRVTAKKVGNGDGYVTIQDGAHHRETLTFNACDYDVNGTHVNDNSYITKELVFYPKTEHMWVEVSETEGTFYIDSIEFIETQE

SEQ ID NO: 518 - protein, 1152 aa, Bacillus thuringiensis
MNRNNQNDYEVIDASNCGCASDDVVQYPLARDPNAVFQNMHYKDYLQTYDGDYTGSFINPNLSINPRDVLQTGINIVGRLLGFLGVPFAGQLVTFYTFLLNQLWPTNDNAVWEAFMAQIEELINQRISEAVVGTAADHLTGLHDNYELYVEALEEWLERPNAARTNLLFNRFTTLDSLFTQFMPSFGTGPGSQNYAVPLLTVYAQAANLHLLLLKDAEIYGARWGLNQNQINSFHTRQQERTQYYTNHCVTTYNTGLDRLRGTNTESWLNYHRFRREMTLMAMDLVALFPYYNVRQYPNGANPQLTREIYTDPIVYNPPANQGICRRWGNNPYNTFSELENAFIRPPHLFDRLNRLTISRNRYTAPTTNSYLDYWSGHTLQSQYANNPTTYETSYGQITSNTRLFNTTNGANAIDSRARNFGNLYANLYGVSYLNIFPTGVMSEITSAPNTCWQDLTTTEELPLVNNNFNLLSHVTFLRFNTTQGGPLATVGFVPTYVWTRQDVDFNNIITPNRITQIPVVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKKAVASLFTRTRDGLQVNVTDYQVDQAANLVSCLSDEQYAHDKKMLLEAVRAAKRLSRERNLLQDPDFNTINSTEENGWKASNGVTISEGGPFYKGRALQLASARENYPTYIYQKVDASELKPYTRYRLDGFVKSSQDLEIDLIHHHKVHLVKNVLDNLVSDTYPDDSCSGINRCEEQQMVNAQLETEHHHPMDCCEAAQTHEFSSYIDTGDLNSTVDQGIWVIFKVRTTDGYATLGNLELVEVGPLLGEPLEREQRENAKWNAELGRKRAETDRVYQDAKQSINHLFVDYQDQQLNPQIGMADIMDAQNLVASISDVYSDAVLQIPGINYEIYTELSNRLQQASYLYTSRNAVQNGDFNNGLDSWNATAGASVQQDGNTHFLVLSHWDAQVSQQFRVQPNCKYVLRVTAEKVGGGDGYVTIRDGAHHTETLTFNACDYDINGTYVTDNTYLTKEVIFYSHTEHMWVEVNETEGAFHIDSIEFVETEK

SEQ ID NO: 519 - protein, 1154 aa, Bacillus thuringiensis kurstaki DP1019
MNRNNQNEYEIIDGTNCDCSSDEVVKYPLASEQNGVLQNMNYKEYLQTYDGDYTGSLINPNLSINTRDVLQTGITIVGRVLGFLGVPFAGQLVTFYTFLLNQLWPTNNNAVWEAFMAQVEELIDQRISDQVVRNALDDLTGLHDYYNEYLAALEEWLDRPNGARANLAFQRFENLHTAFVTRMPSFGTGPGSQRDAVALLTVYAQAANLHLLLLKDAEIYGARWGLQQSQINLYFNAQQDRTRIYTNHCVATYNRGLEDLKGTNTESWYNYHQFRREMTLMAMDLVALFPYYNVRQYPNGANPQLTREIYTDPVVFNPPANQGLCRRWGNNPYMTFSGLENAFIRPPHLFDRLNSLTINSHRFPISSNFMDYWAGHTLRRSYMNNSAVQEDSYGAITPTRVTINPGVNGTNHIESTAVDFRSGLVGIYGVHRASFVPGGLFNGTISPANAGCRNLHDTRDVLPLEENNGSPSHRLSHVTFLSFQTNQAGSLANGGSVPLYVWARQDIDFNNTITANRITQLPLVKAFEIAAGTTIVKGPGFTGGDILRRTSTGTLGTIRVNVNSPLTQRYRVRFRYASTVDFDFFVSRGGTTVNNFRFPRTMSRGQESRYESYVTSEFTTPFTFTQSQDFIRTSIQGLSGNGEVYLDRIEIIPVNPAREAEEDLEAAKKAVASLFTRTRDGLQVNVTDYQVDQAANLVSCLSDEQYGHDKKMLLEAVRAAKRLSRERNLLQDPDFNEINSIEENGWKASNGVTISEGGPFFKGRALQLASARENYPTYIYQKVDASVLKPYTRYRLDGFVKSSQDLEIDLIHHHKVHLVKNVPDNLVSDTYSDGSCSGINRCDEQHQVDMQLDAEHHPMDCCEAAETHEFSSYIDTGDLNPSVDQGIWVVLKVRTTDGYATLGNLELVEVGSLSGESLEREKRENAEWNAELGRKRAETERVYQAAKRAINHLFVDYQDQQLNLEVGLAEINEVSNLVESIPSVYSDTVLQIPGVNYEIYTELSNRLQQASYLYMSRNAVQNGDFNNGLDSWNATTDATVQQDGTMHFLVLSHWDAQVSQPLRVQPNCKYVLRVTARKVGSGDGYVTIRNGAHHHETLIFNACDYDINGTYVNENTYITKEVVFYPHTEHTWVEVSESEGAFYIDSIELIETQE

SEQ ID NO: 520 - protein, 249 aa, Bacillus thuringiensis israelensis
MENLNHCPLEDIKVNPWKTPQSTARVITLRVEDPNEINNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 521 - protein, 249 aa, Bacillus thuringiensis israelensis; identical to SEQ ID NO: 520

SEQ ID NO: 522 - protein, 249 aa, Bacillus thuringiensis LLP29
MENLNHCPLEDIKVNPWKTPQSKARVITLRVEDPNEINNLLSINEIDNPNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 523 - protein, 131 aa, Bacillus thuringiensis LDC-9
MFFLLTKLIISNYILQAIMLANAFQNALVPTSTDFGDALRFSMPKGLEIANTITPMGAVVSYVDQNVTQTNNQVSVMINKVLEVLKTVLGVALSGSVIDQLTAAVTNTFTNLNTQKNEAWICWGKETANQT

SEQ ID NO: 524 - protein, 252 aa, Bacillus thuringiensis s. israelensis IPS82
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNI

SEQ ID NO: 525 - protein, 262 aa, Bacillus thuringiensis LLP29
MHLNNLNNFNNLENNGEYHCSAPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIK

SEQ ID NO: 526 - protein, 156 aa, Bacillus thuringiensis israelensis PG14
NTFQGAIDPLTLNFNFEKALQIANGLPNAGVTGTINQSVIHQTIEVSVMISQIKEIIRSVLGLVINSANFWNRVVSAITNTFTNLEPQVDENWIVWRNLSATQTSYFYKILFSIQNEDTGRFMAILPIAFEITVDVQKQQLLFITIKDSARYEVKM

SEQ ID NO: 527 - protein, 156 aa, Bacillus thuringiensis morrisoni HD12
NTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKM

SEQ ID NO: 528 - protein, 157 aa, Bacillus thuringiensis tenebrionis
NTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMK

SEQ ID NO: 529 - protein, 263 aa, Bacillus thuringiensis T36
MHLNNLNNFNNLENNGEYHRSGPIIKKPFRHIALTVPSSDITNFNEIFYVEPQYIAQAIRLTNTFQGAIDPLTLNFNFEKALQIANGLPNAGVTGTIIQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 530 - protein, 119 aa, Bacillus thuringiensis LDC-9
LQIANGIPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVGK

SEQ ID NO: 531 - protein, 260 aa, Bacillus thuringiensis medellin
MYINNFDFPEKNNDYQCSGPIIKKPFRHIALTVPSSDITNFNEIFYVEPQYIAQALRLTNTFQGAIDPLTLNFNFEKALQIANGLPNAGVTGTLNQSVIHQTIEISVMISQIKEIIRSVLGLVINSANFWNNVVSAITNTFTNLEPQVDENWIVWRNLSANQTSYYYKILFSIQNEDTGRFMAVLPIAFEINVDVHKQQLLFITIKDSARYEVKMKALTVVQALDSYNAPIIDVFNIHNYSLHRPNYHILQNLNVNPIKS

SEQ ID NO: 532 - protein, 138 aa, Bacillus thuringiensis serovar darmstadiensis
QIANGIPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYAVTMKA

SEQ ID NO: 533 - protein, 231 aa, Bacillus thuringiensis
MFFNRVITLTVPSSDVVNYSEIYQVAPQYVNQALTLAKYFQGAIDGSTLRFDFEKALQIANDIPQAAVVNTLNQTVQQGTVQVSVMIDKIVDIMKNVLSIVIDNKKFWDQVTAAITNTFTNLNSQESERWIFYYKEDAHKTSYYYNILFAIQDEETGGVMATLPIAFDISVDIEKEKVLFVTIKDTENYAVTVKAINVVQALQSSRDSKVVDAFKSPRHLPRKRHKICSNS

SEQ ID NO: 534 - protein, 41 aa, Atrax robustus
GSQYCAPADQPCSLNTQPCCDDVTCTQERNENGHTAYYCRV

SEQ ID NO: 535 - protein, 98 aa, Hadronyche versuta
MKFSKLSLTLALILTQALFVLCGKINEDFMKNGLESQTLHDEIRKPIDSENPDTERLLDCLLDNRVCSSDRDCCGMTPSCTMGLCVPNVGGLVGGILG

SEQ ID NO: 536 - protein, 98 aa, Atrax robustus; identical to SEQ ID NO: 535

SEQ ID NO: 537 - protein, 98 aa, Hadronyche versuta
MKFSKLSLTLALILTQAIFVLCGKINEDFMKNDLESQALRDEIRKPIDSENPDTERLLDCLLDNRVCSSDKDCCGMTPSCTMGLCVPSVGGLVGGILG

SEQ ID NO: 538 - protein, 98 aa, Hadronyche versuta
MKFSKLSLTLALILTQAIFVLCGKINEDFMKNDLESHALHDEIRKPINSENPDTERLLDCLLDNRVCSSDKDCCGMTPSCTMGLCVPSVGGLVGGILG

SEQ ID NO: 539 - protein, 98 aa, Hadronyche versuta
MKFSKLSLTLALILTQALFVLCGKINEDFMKNGLESQALHDEIRKPIDSENPDTERLLDCLLDNRVCSSDKDCCGMTPSCTMGLCVPSVGGLVGGILG

SEQ ID NO: 540 - protein, 98 aa, Hadronyche versuta
MKFSKLSLTLALILTQVIFVLCGKINEDFMKNGLESQALHDEIRKPIDSENPDTERLLDCLLDNRVCSSDKDCCGMTPSCTMGLCVPSVGGLVGGILG

SEQ ID NO: 541 - protein, 93 aa, Hadronyche versuta
MKFSKLSLTLALILTQALFVLCDFMKNGLESQALHDEIRKSIDSENPDTERLLDCLLDNRVCSSDKDCCGMTPSCTMGLCVPSVGGLVGGILG

SEQ ID NO: 542 - protein, 98 aa, Atrax robustus
MKFSKLSLTLALILTQVLFVLCGKINEDFMKHGLESQALHDEIRKPIDSENPDTERLLDCLLDNRVCSSDKDCCGMTPSCTMGLCVPSVGGLVGGILG

SEQ ID NO: 543 - protein, 98 aa, Hadronyche versuta
MKFSKLSLTLALILTQAIFVLCGKINEDFMKNDLESQALHDEIRKPINSENPDTERLLDCLLDNRVCSSDKDCCGMTPSCTMGLCVPSVGGLVGGILG

SEQ ID NO: 544 - protein, 98 aa, Hadronyche versuta
MKFSKLSLTLALILTQALFVLCGKINEDFMKNGLESQALHDEIRKPIDSENPDTERLLDCLLDNRVCSSDRDCCGMTPSCTMGLCVPNVGGLVGDILG

SEQ ID NO: 545 - protein, 97 aa, Hadronyche versuta
MKFSKLSLTLALILTQVLFVLCGKIEDFMKNGLESQALHDEIRKPIDSENPDTERLLDCLLDNRVCSSDKDCCGMTPSCTMGLCVPNVGGLVGGILG

SEQ ID NO: 546 - protein, 93 aa, Hadronyche versuta
MKFSKLSLTLALILTQALFVLCDFMKNGLESQALHDEIRKPIDSENPDTERLLDCLLDNRVCSSDKDCCGMTPSCTMGLCVPNVGGLVGGILG

SEQ ID NO: 547 - protein, 98 aa, Hadronyche versuta
MKFSKLSLTLALILTQALFVLCGKINEDFMKNGLESQALHDEIRKPIDSENPDTERLLDCLLDNRICSSDKDCCGMTPSCTMGLCVPNVGGLVGGILG

SEQ ID NO: 548 - protein, 98 aa, Hadronyche versuta
MKFSKLSLTLALILTQALFVLCGKINEDFMKNGLESQALHDEIRKPIDSENPDTERLLDCLLDNRVCSSDKDCCGMTPSCTMGLCVPNVGGLVGGILG

SEQ ID NO: 549 - protein, 98 aa, Hadronyche versuta
MKFSKLSLTLALILTQAIFVLCGKINEDFMKNDLESQALHDEIRKPINSENPDTERLLDCLLDSRVCSSDKDCCGMTPSCTMGLCVPSVGGLVGGILG

SEQ ID NO: 550 - protein, 96 aa, Atrax robustus
MKFSKLSITLAVILTQAVFVFCGMTNEDFMEKGLESNELPDAIKKPVNSGKPDTKRLLDCVLSRMCFSNANCCGLTPPCKMGLCVPNVGGLLGGIL

SEQ ID NO: 551 - protein, 96 aa, Atrax robustus
MKFSKLSITLAVILTQAVFVFCGMTNEDFMEKGLESNELHDAIKKPVNSGKPDTERLLDCVLSRMCSSDANCCGLTPTCKMGLCVPNVGGLLGGIL

SEQ ID NO: 552 - protein, 101 aa, Hadronyche versuta
MKFSKLSLTLALILTQALFVLCGKINEDFMEHGLESHALHDEIRKPIDTEKADAERLVDCVVNTLGCSSDKDCCGMTPSCTLGICAPSVRGLVGGLLGRAL

SEQ ID NO: 553 - protein, 101 aa, Hadronyche versuta
MKFSKLSLTLALILTQALFVLCMKINEDFMENGLESHALHDEIRKPIDTEKADAERLVDCVVNTLGCSSDKDCCGMTPSCTLGICAPSVGGLVGGLLGRAL

SEQ ID NO: 554 - protein, 101 aa, Hadronyche versuta
MKFSKLSLTFALILTQALFVLCGKINEDFMDNGLESHALHDEIRKPIHTEKADAERLVDCVLNTLGCSSDKDCCGMTPSCTLGICAPSVGGLVGGLLGRAL

SEQ ID NO: 555 - protein, 101 aa, Hadronyche infensa
MKFSKLSLTLALILTQALFVLCGKINEDFMEHGLESHALHDEIRKPIDTEKADAERLVDCVVNTLGCSSDKDCCGMTPSCTLGICAPSVGGLVGGLLGRAL

SEQ ID NO: 556 - protein, 101 aa, Hadronyche infensa
MKFSKLSVTLALILTQTLLVLCGKINEDFMENGLESHALHDEIRKPIDTDKAYAERVLDCVVNTLGCSSDKDCCGMTPSCTLGICAPSVGGLVGGLLGRAL

SEQ ID NO: 557 - protein, 101 aa, Hadronyche versuta
MKFSKLSLTLALILTQALFVLCGKINEDFMENGLESHALHDEIRKPIDTEKADAERLVDCVVNTLGCSSDKDCCGMTPSCTLGICAPSVGGLVGGLLGRAL

SEQ ID NO: 558 - protein, 101 aa, Hadronyche versuta
MKFSKLSLTLALILTQALFVLCGKINEDFMENGLESHALHDEIRKPIDTEKADAERVLDCVVNTLGCSSDKDCCGMTPSCTLGICAPSVGGLVGGLLGRAL

SEQ ID NO: 559 - protein, 100 aa, Hadronyche versuta
MKFSKLSLTLALILTQALFVLCGKINEDFMENGLESHALHDEIRKPIDTEKADAERLVDCVVNTLGCSSDKDCCGMTPSCTLGICAPSVGLVGGLLGRAL

SEQ ID NO: 560 - protein, 97 aa, Atrax robustus
MKFSKLSITLAVILTQAVFVFCGMTNEDFMEKGFKSNDLQYAIKQPVNSGKPDTERLLDCVLSRVCSSDENCCGLTPTCTMGLCVPNVGGLLGGLLS

SEQ ID NO: 561 - protein, 97 aa, Atrax robustus
MKFSKLSITLVVILTQAVFVFCGMTNEDFMEKGFKSNDLQYAIRQPVNSGKPDTERLLDCVLSRVCSSDENCCGLTPTCTMGLCVPNVGGLLGGLLS

SEQ ID NO: 562 - protein, 101 aa, Hadronyche versuta
MKFSKLSLTLALILTQALLVLCGKINEDFMENGLESHALHDEIRKPLDTENPDTERQLDCVLNTLGCSSDKDCCGMTPSCTLGICAPNVGGLVGGLLGRAL

SEQ ID NO: 563 - protein, 101 aa, Hadronyche versuta
MKFSKLSLTLALILTQVLLVVCGKINEDFMENGLESHALHDEIRKPIDTEKADAERVLDCVVNTLGCSSDKDCCGMTPSCTLGICAPSVGGIVGGLLGRAL

SEQ ID NO: 564 - protein, 101 aa, Hadronyche versuta
MKFSKLSLTLALILAQAIFVLCGKINEDFMENGLESHALHDEIRKPIDTEKADAERVVDCVLNTLGCSSDKDCCGMTPSCTLGICAPSVGGLVGGLLGRAL

SEQ ID NO: 565 - protein, 101 aa, Hadronyche versuta
MKFSKLSLTLALILTQALLVVCGKINEDFMENGLESHALHDEIRKPIDTEKADAERVLDCVVNILGCSSDKDCCGMTPSCTLGICAPSVGGIVGGLLGRAL

SEQ ID NO: 566 - protein, 101 aa, Hadronyche versuta
MKFSKLSLTLALILTQALLVVCGKINEDFMENGLESHALHDEIRKPIDTEKADAERVLDCVVNTLGCSSDKDCCGMTPSCTLGICAPSVGGIVGGLLGRAL

SEQ ID NO: 567 - protein, 101 aa, Hadronyche infensa
MKFSKLSLTLALILTQALLVVCGKINEDFMENGLESHALHDEIRKSIDTEKADAERVLDCVVNTLGCSSDKDCCGMTPSCTLGICAPSVGGIVGGLLGRAL

SEQ ID NO: 568 - protein, 95 aa, Hadronyche versuta
MKFSKLSLTFALILTQTLLVLCDFMENGLESHALHDEIRKPIDTEKADAERVLDCVVNTLGCSSDKDCCGMTPSCTLGICAPSVGGLVGGLLGRA

SEQ ID NO: 569 - protein, 76 aa, Hadronyche versuta
MNTATGFIVLLVLATVLGGVEAGESHMRKDAMGRVRRQYCVPVDQPCSLNTQPCCDDATCTQERNENGHTVYYCRA

SEQ ID NO: 570 - protein, 39 aa, Hadronyche versuta; identical to SEQ ID NO: 6

SEQ ID NO: 571 - protein, 39 aa, Hadronyche versuta
GSCVPVDQPCSLNTQPCCDDATCTQERNENGHTVYYCRA

SEQ ID NO: 572 - protein, 75 aa, Hadronyche versuta
MNTATGFIVLLVLATILGGIEAGESHMRKDAMGRVRRQYCVPVDQPCSLNTQPCCDDATCTQERNENGHTVYYCR

SEQ ID NO: 573 - protein, 38 aa, Hadronyche versuta
QYCVPVDQPCSLNTQPCCDDATCTQERNENGHTVYYCR

SEQ ID NO: 574 - protein, 75 aa, Hadronyche versuta
MNTATGFIVLLVLATVLGGIEAGESHMRKDAMGRVRRQYCVPVDQPCSLNTQPCCDDATCTQELNENDNTVYYCR

SEQ ID NO: 575 - protein, 38 aa, Hadronyche versuta
QYCVPVDQPCSLNTQPCCDDATCTQELNENDNTVYYCR

SEQ ID NO: 576 - protein, 76 aa, Hadronyche versuta
MNTATGFIVLLVLATILGGIEAGESHMRKDAMGRVRRQYCVPVDQPCSLNTQPCCDDATCTQERNENGHTVYYCRA

SEQ ID NO: 577 - protein, 39 aa, Hadronyche versuta; identical to SEQ ID NO: 6

SEQ ID NO: 578 - protein, 76 aa, Hadronyche versuta
MNTATGFIVLLVLATVLGGIEAGESHMRKDAMGRVRRQYCVPVDQPCSLNTQPCCDDATCTQELNENANPVYYCRA

SEQ ID NO: 579 - protein, 39 aa, Hadronyche versuta
QYCVPVDQPCSLNTQPCCDDATCTQELNENANPVYYCRA

SEQ ID NO: 580 - protein, 76 aa, Hadronyche versuta
MNTTTGFIVLLVLATILGGIEAGESHMRKDAMGRVRRQYCVPVDQPCSLNTQPCCDDATCTQELNENDNTVYYCRA

SEQ ID NO: 581 - protein, 39 aa, Hadronyche versuta
QYCVPVDQPCSLNTQPCCDDATCTQELNENDNTVYYCRA

SEQ ID NO: 582 - protein, 76 aa, Hadronyche versuta
MNTATGFIVLLVLATVLGGIEAGESHMRKDAMGRVRRQYCVPVDQPCSLNTQPCCDDATCTQELNENDNTVYYCRA

SEQ ID NO: 583 - protein, 39 aa, Hadronyche versuta; identical to SEQ ID NO: 581

SEQ ID NO: 584 - protein, 76 aa, Hadronyche versuta
MNTATGFIVFLVLATVLGGIEAGESHMRKDAMGRVRRQYCVPVDQPCSLNTQPCCDDATCTQELNENDNTVYYCRA

SEQ ID NO: 585 - protein, 39 aa, Hadronyche versuta; identical to SEQ ID NO: 581

SEQ ID NO: 586 - protein, 76 aa, Hadronyche versuta
MNTATGFIVLLVLATVLGGIEARESHMRKDAMGRVRRQYCVPVDQPCSLNTQPCCDDATCTQELNENDNTVYYCRA

SEQ ID NO: 587 - protein, 39 aa, Hadronyche versuta; identical to SEQ ID NO: 581

SEQ ID NO: 588 - protein, 37 aa, Hadronyche versuta; identical to SEQ ID NO: 24

SEQ ID NO: 589 - protein, 45 aa, Hadronyche versuta
LLACLFGNGRCSSNRDCCELTPVCKRGSCVSSGPGLVGGILGGIL

SEQ ID NO: 590 - protein, 19 aa, Hadronyche versuta
EDTRADLQGGEAAEKVFRR

SEQ ID NO: 591 - protein, 15 aa, Hadronyche versuta
GESHVREDAMGRARR

SEQ ID NO: 592 - protein, 78 aa, Atrax robustus
MNTATGVIALLVLATVIGCIEAEDTRADLQGGEAAEKVFRRSPTCIPSGQPCPYNENCCSQSCTFKENENGNTVKRCD

SEQ ID NO: 593 - protein, 37 aa, Atrax robustus; identical to SEQ ID NO: 24

SEQ ID NO: 594 - protein, 78 aa, Atrax robustus
MNTATGVIALLVLVTVIGCIEAEDTRADLQGGEAAEKVFRRSPTCIPSGQPCPYNENCCSQSCTFKENENGNTVKRCD

SEQ ID NO: 595 - protein, 37 aa, Atrax robustus; identical to SEQ ID NO: 24

SEQ ID NO: 596 - protein, 78 aa, Atrax robustus
MNTATGVIALLVLATVIGCIEAEDTRADLQGGEAAEKVFRRSPTCIPSGQPCPYNENCCSQSCTFKENETGNTVKRCD

SEQ ID NO: 597 - protein, 37 aa, Atrax robustus
SPTCIPSGQPCPYNENCCSQSCTFKENETGNTVKRCD

SEQ ID NO: 598 - protein, 78 aa, Atrax robustus
MNTATGVIALLVLATVIGCIEAEDTRADLQGGEAAEKVFRRSPTCIPSGQPCPYNENCCSQSCTFKENENANTVKRCD

SEQ ID NO: 599 - protein, 37 aa, Atrax robustus
SPTCIPSGQPCPYNENCCSQSCTFKENENANTVKRCD

SEQ ID NO: 600 - protein, 78 aa, Atrax robustus
MNTATGVIALLVLATVIGCIEAEDTRADLQGGEAAEKVFRRSPTCIPSGQPCPYNENCCSKSCTYKENENGNTVQRCD

SEQ ID NO: 601 - protein, 37 aa, Atrax robustus
SPTCIPSGQPCPYNENCCSKSCTYKENENGNTVQRCD

SEQ ID NO: 602 - protein, 73 aa, Atrax robustus
MNTATGFIVLLVLATVLGCIEAGESHVREDAMGRARRGACTPTGQPCPYNESCCSGSCQEQLNENGHTVKRCV

SEQ ID NO: 603 - protein, 36 aa, Atrax robustus
GACTPTGQPCPYNESCCSGSCQEQLNENGHTVKRCV

SEQ ID NO: 604 - protein, 79 aa, Hadronyche versuta
MNTATGFIVLLVLATVIGCISADFQGGFEPYEGEDAERIFRRSPTCIPTGQPCPYNENCCSQSCTYKANENGNQVKGCD

SEQ ID NO: 605 - protein, 37 aa, Hadronyche versuta
SPTCIPTGQPCPYNENCCSQSCTYKANENGNQVKGCD

SEQ ID NO: 606 - protein, 79 aa, Hadronyche versuta
MNTATGFIVLLVLATVIGCISADFQGGFEPYEEEDAERIFRRSPTCIPTGQPCPYNENCCNQSCTYKANENGNQVKRCD

SEQ ID NO: 607 - protein, 37 aa, Hadronyche versuta
SPTCIPTGQPCPYNENCCNQSCTYKANENGNQVKRCD

SEQ ID NO: 608 - protein, 79 aa, Hadronyche versuta
MNTATGFIVLLVLATVIGCISADFQGGFEPYEEEDAERIFRRSPTCIPTGQPCPYNENCCSQSCTYKANENGNQVKRCD

SEQ ID NO: 609 - protein, 37 aa, Hadronyche versuta
SPTCIPTGQPCPYNENCCSQSCTYKANENGNQVKRCD

SEQ ID NO: 610 - protein, 79 aa, Hadronyche versuta
MNTATGFIVLLVLATVIGCISVDFQGGFESYEEEDAERIFRRSPTCIPTGQPCPYNENCCSQSCTYKANENGNQVKRCD

SEQ ID NO: 611 - protein, 37 aa, Hadronyche versuta; identical to SEQ ID NO: 609

SEQ ID NO: 612 - protein, 78 aa, Hadronyche versuta
MNTATGFIVLLVLATVIGCISADFQGGFESSVEDAERLFRRSSTCIRTDQPCPYNESCCSGSCTYKANENGNQVKRCD

SEQ ID NO: 613 - protein, 37 aa, Hadronyche versuta
SSTCIRTDQPCPYNESCCSGSCTYKANENGNQVKRCD

SEQ ID NO: 614 - protein, 78 aa, Hadronyche versuta
MNTATGFIVLLVLATVIGCISADFQGGFEPYEEEDAERIFRRSTCTPTDQPCPYHESCCSGSCTYKANENGNQVKRCD

SEQ ID NO: 615 - protein, 36 aa, Hadronyche versuta
STCTPTDQPCPYHESCCSGSCTYKANENGNQVKRCD

SEQ ID NO: 616 - protein, 78 aa, Hadronyche versuta
MNTATGFIVLLVLATVIGCISADFEGSFEPYEEEDAERIFRRSTCTPTDQPCPYDESCCSGSCTYKANENGNQVKRCD

SEQ ID NO: 617 - protein, 36 aa, Hadronyche versuta
STCTPTDQPCPYDESCCSGSCTYKANENGNQVKRCD

SEQ ID NO: 618 - protein, 78 aa, Hadronyche versuta
MNTATGFIVLLVLATVIGCISADFQGSFEPYEEEDAERIFRRSTCTPTDQPCPYDESCCSGSCTYKANENGNQVKRCD

SEQ ID NO: 619 - protein, 36 aa, Hadronyche versuta; identical to SEQ ID NO: 617

SEQ ID NO: 620 - protein, 78 aa, Hadronyche versuta
MNTATGFIVLLVLATVIGCISADFQGSFEPYEEEDAERIFRRSTCTPTDQPCPYHESCCSGSCTYKANENGNQVKRCD

SEQ ID NO: 621 - protein, 36 aa, Hadronyche versuta; identical to SEQ ID NO: 615

SEQ ID NO: 622 - protein, 78 aa, Hadronyche versuta
MNTATGFIVLLVLATVIGCISADFQGGFEPYEEEDAERIFRRSTCTPTDQPCPYDESCCSGSCTYKANENGNQVKRCD

SEQ ID NO: 623 - protein, 36 aa, Hadronyche versuta; identical to SEQ ID NO: 617

SEQ ID NO: 624 - protein, 36 aa, Atrax infensus; identical to SEQ ID NO: 615

SEQ ID NO: 625 - protein, 37 aa, Atrax infensus; identical to SEQ ID NO: 609

SEQ ID NO: 626 - protein, 37 aa, Atrax infensus; identical to SEQ ID NO: 613

SEQ ID NO: 627 - protein, 37 aa, Atrax robustus
SSVCIPSGQPCPYNEHCCSGSCTYKENENGNTVQRCD

SEQ ID NO: 628 - protein, 37 aa, Hadronyche versuta; identical to SEQ ID NO: 24

SEQ ID NO: 629 - protein, 37 aa, Atrax formidabillis
SPTCTGADRPCAACCPCCPGTSCKGPEPNGVSYCRND

SEQ ID NO: 630 - protein, 36 aa, Atrax formidabillis
SPTCTGADRPCAACCPCCPGTSCKGPEPNGVSYCRN

SEQ ID NO: 631 - protein, 37 aa, Atrax formidabillis
SPTCIRSGQPCPYNENCCSQSCTFKTNENGNTVKRCD

SEQ ID NO: 632 - protein, 9 aa, Atrax infensus
NGNQVKRCD

SEQ ID NO: 633 - protein, 9 aa, Atrax infensus
NGNQVKRCD

SEQ ID NO: 634 - protein, 9 aa, Hadronyche versutus
NGNTVKRCD

SEQ ID NO: 635 - protein, 15 aa, Hadronyche versutus
SPTCIPSGQPCPYNE

SEQ ID NO: 636 - protein, 16 aa, Agelenopsis aperta
ECVPENGHCRDWYDEC

SEQ ID NO: 637 - protein, 37 aa, Agelenopsis aperta
ECATKNKRCADWAGPWCCDGLYCSCRSYPGCMCRPSS

SEQ ID NO: 638 - protein, 38 aa, Agelenopsis aperta
ADCVGDGQRCADWAGPYCCSGYYCSCRSMPYCRCRSDS

SEQ ID NO: 639 - protein, 37 aa, Agelenopsis aperta
ACVGENQQCADWAGPHCCDGYYCTCRYFPKCICRNNN

SEQ ID NO: 640 - protein, 37 aa, Agelenopsis aperta
ACVGENKQCADWAGPHCCDGYYCTCRYFPKCICRNNN

SEQ ID NO: 641 - protein, 37 aa, Agelenopsis aperta
DCVGESQQCADWAGPHCCDGYYCTCRYFPKCICVNNN

SEQ ID NO: 642 - protein, 36 aa, Hololena curta
SCVGEYGRCRSAYEDCCDGYYCNCSQPPYCLCRNNN

SEQ ID NO: 643 - protein, 38 aa, Hololena curta
ADCVGDGQKCADWFGPYCCSGYYCSCRSMPYCRCRSDS

SEQ ID NO: 644 - protein, 70 aa, Androctonus australis Hector
KKNGYAVDSSGKAPECLLSNYCNNQCTKVHYADKGYCCLLSCYCFGLNDDKKVLEISDTRKSYCDTTIIN

SEQ ID NO: 645 - protein, 70 aa, Androctonus australis Hector
KKNGYAVDSSGKAPECLLSNYCNNECTKVHYADKGYCCLLSCYCFGLNDDKKVLEISDTRKSYCDTTIIN

SEQ ID NO: 646 - protein, 70 aa, Androctonus australis Hector
KKDGYAVDSSGKAPECLLSNYCYNECTKVHYADKGYCCLLSCYCFGLNDDKKVLEISDTRKSYCDTPIIN

SEQ ID NO: 647 - protein, 33 aa, Scorpio maurus palmatus
ALPLSGEYEPCVRPRKCKPGLVCNKQQICVDPK

SEQ ID NO: 648 - protein, 61 aa, Leiurus quinquestriatus
DGYIRKRDGCKLSCLFGNEGCNKECKSYGGSYGYCWTWGLACWCEGLPDEKTWKSETNTCG

SEQ ID NO: 649 - protein, 61 aa, Buthotus judaicus
DGYIRKKDGCKVSCIIGNEGCRKECVAHGGSFGYCWTWGLACWCENLPDAVTWKSSTNTCG

SEQ ID NO: 650 - protein, 39 aa, Atrax robustus
GSSPTCIPSGQPCPYNENCCSQSCTFKENENGNTVKRCD

SEQ ID NO: 651 - protein, 39 aa, Atrax robustus
GSAICTGADRPCAACCPCCPGTSCKAESNGVSYCRKDEP

SEQ ID NO: 652 - protein, 41 aa, Atrax robustus; identical to SEQ ID NO: 5

SEQ ID NO: 653 - protein, 60 aa, Hadronyche versuta
MNTATGFIVLLVLATVLGGVEAGESHMRKDAMGRVRRQYCVPVDQPCSLNTQPCCDDATC

SEQ ID NO: 654 - protein, 39 aa, Hadronyche versuta
QYCVPVDQPCSLNTQPCCDDAYCTQERNENGHTVYYCRA

SEQ ID NO: 655 - protein, 39 aa, Hadronyche versuta; identical to SEQ ID NO: 571

SEQ ID NO: 656 - protein, 74 aa, Hadronyche versuta
MNTATGFIVLLVLATILGGIEAGESHMRKDAMGRVRRQYCVPVDQPCSLNTQPCCDDATCTERNENGHTVYYCR

SEQ ID NO: 657 - protein, 38 aa, Hadronyche versuta; identical to SEQ ID NO: 573

SEQ ID NO: 658 - protein, 75 aa, Hadronyche versuta
MNTATGFIVLLVLATVLGGIEAGESHMRKDAMGRVRRQYCVPVDQPCSLNTQPCCDDAYCTQELNENDNTVYYCR

SEQ ID NO: 659 - protein, 38 aa, Hadronyche versuta; identical to SEQ ID NO: 575

SEQ ID NO: 660 - protein, 76 aa, Hadronyche versuta; identical to SEQ ID NO: 576

SEQ ID NO: 661 - protein, 39 aa, Hadronyche versuta; identical to SEQ ID NO: 6

SEQ ID NO: 662 - protein, 76 aa, Hadronyche versuta; identical to SEQ ID NO: 578

SEQ ID NO: 663 - protein, 39 aa, Hadronyche versuta; identical to SEQ ID NO: 579

SEQ ID NO: 664 - protein, 76 aa, Hadronyche versuta
MNTTTGFIVLLVLATILGGIEAGESHMRKDAMGRVRRQYCVPVDQPCSLNTQPCCDDAYCTQELNENDNTVYYCRA

SEQ ID NO: 665 - protein, 39 aa, Hadronyche versuta; identical to SEQ ID NO: 581

SEQ ID NO: 666 - protein, 76 aa, Hadronyche versuta; identical to SEQ ID NO: 582

SEQ ID NO: 667 - protein, 39 aa, Hadronyche versuta; identical to SEQ ID NO: 581

SEQ ID NO: 668 - protein, 76 aa, Hadronyche versuta; identical to SEQ ID NO: 584

SEQ ID NO: 669 - protein, 39 aa, Hadronyche versuta; identical to SEQ ID NO: 581

SEQ ID NO: 670 - protein, 76 aa, Atrax robustus; identical to SEQ ID NO: 586

SEQ ID NO: 671 - protein, 39 aa, Atrax robustus; identical to SEQ ID NO: 581

SEQ ID NO: 672 - protein, 22 aa, Hadronyche versuta
  MISC_FEATURE (4)..(4): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (10)..(10): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (16)..(16): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (20)..(20): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MNTXTGFIVXLVLATXLGGXEA

SEQ ID NO: 673 - protein, 15 aa, Hadronyche versuta
  MISC_FEATURE (1)..(1): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
XESHMRKDAMGRVRR

SEQ ID NO: 674 - protein, 64 aa, Leiurus quinquestriatus hebraeus
VRDAYIAKNYNCVYECFRDAYCNELCTKNGASSGYCQWAGKYGNACWCYALPDNVPIRVPGKCR

SEQ ID NO: 675 - protein, 64 aa, Leiurus quinquestriatus quinquestriatus
VRDAYIAKNYNCVYECFRDSYCNDLCTKNGASSGYCQWAGKYGNACWCYALPDNVPIRVPGKCH

SEQ ID NO: 676 - protein, 65 aa, Bothus occitanus tunetanus
VRDAYIAQNYNCVYFCMKDDYCNDLCTKNGASSGYCQWAGKYGNACWCYALPDNVPIRIPGKCHS

SEQ ID NO: 677 - protein, 64 aa, Hottentotta judaica
GRDAYALDNLNCAYTCGSKSYCNTECTKNGAVSGYCQWLGKYGNACWCINLPDKVPIRIPGACR

SEQ ID NO: 678 - protein, 67 aa, Leiurus quinquestriatus hebraeus
VRDGYIAQPENCVYHCFPGSSGCDTLCKEKGGTSGHCGFKVGHGLACWCNALPDNVGIIVEGEKCHS

SEQ ID NO: 679 - protein, 66 aa, Buthus occitanus mardochei
GRDGYIAQPENCVYHCFPGSSGCDTLCKEKGATSGHCGFLPGSGVACWCDNLPNKVPIVVGGEKCH

SEQ ID NO: 680 - protein, 65 aa, Buthus occitanus mardochei
GRDAYIAQPENCVYECAKNSYCNDLCTKNGAKSGYCQWLGKYGNACWCEDLPDNVPIRIPGKCHF

SEQ ID NO: 681 - protein, 64 aa, Bothus martensii Karsch
VRDAYIAKPHNCVYECARNEYCNDLCTKNGAKSGYCQWVGKYGNGCWCIELPDNVPIRVPGKCH

SEQ ID NO: 682 - protein, 64 aa, Bothus martensii Karsch
VRDAYIAKPHNCVYSCARNEWCNDLCTKNGAKSGYCQWVGKYGNGCWCIELPDNVPIRVPGKCH

SEQ ID NO: 683 - protein, 64 aa, Bothus martensii Karsch
VRDAYIAKPENCVYHCAGNEGCNKLCTDNGAESGYCQWGGRYGNACWCIKLPDDVPIRVPGKCH

SEQ ID NO: 684 - protein, 66 aa, Bothus martensii Karsch
VRDGYIALPHNCAYGCLNNEYCNNLCTKDGAKIGYCNIVGKYGNACWCIQLPDNVPIRVPGRCHPA

SEQ ID NO: 685 - protein, 64 aa, Leiurus quinquestriatus
VRDGYIAQPENCVYHCIPDCDTLCKDNGGTGGHCGFKLGHGIACWCNALPDNVGIIVDGVKCHK

SEQ ID NO: 686 - protein, 66 aa, Leiurus quinquestriatus
VRDGYIAKPENCAHHCFPGSSGCDTLCKENGGTGGHCGFKVGHGTACWCNALPDKVGIIVDGVKCH

SEQ ID NO: 687 - protein, 66 aa, Centruroides noxius
KEGYLVDIKNTGCKYECLKLGDNDYCLRECKQQYGKGAGGYCYAFACWCTHLYEQAIVWPLPNKRC

SEQ ID NO: 688 - protein, 66 aa, Centruroides noxius
KEGYLVELGTGCKYECFKLGDNDYCLRECKARYGKGAGGYCYAFGCWCTQLYEQAVVWPLKNKTCR

SEQ ID NO: 689 - protein, 66 aa, Centruroides suffusus suffusus
KEGYLVSKSTGCKYECLKLGDNDYCLRECKQQYGKSSGGYCYAFACWCTHLYEQAVVWPLPNKTCN

SEQ ID NO: 690 - protein, 66 aa, Centruroides suffusus suffusus
KEGYLVNSYTGCKFECFKLGDNDYCLRECRQQYGKGSGGYCYAFGCWCTHLYEQAVVWPLPNKTCN

SEQ ID NO: 691 - protein, 76 aa, Buthotus judaicus
KKNGYPLDRNGKTTECSGVNAIAPHYCNSECTKVYVAESGYCCWGACYCFGLEDDKPIGPMKDITKKYCDVQIIPS

SEQ ID NO: 692 - protein, 70 aa, Androctonus australis Hector; identical to SEQ ID NO: 645

SEQ ID NO: 693 - protein, 70 aa, Leiurus quinquestriatus quinquestriatus
KKNGYAVDSSGKAPECLLSNYCYNECTKVHYADKGYCCLLSCYCVGLSDDKKVLEISDARKKYCDFVTIN

SEQ ID NO: 694 - protein, 70 aa, Leiurus quinquestriatus hebraeus
KKNGFAVDSNGKAPECFFDHYCNSECTKVYYAEKGYCCLLSCYCFGLNDDKKVLEISDTTKKYCDFTIIN

SEQ ID NO: 695 - protein, 72 aa, Bothus martensii Karsch
KKNGYAVDSSGKVAECLFNNYCNNECTKVYYADKGYCCLLKCYCFGLLDDKPVLDIWDSTKNYCDVQIIDLS

SEQ ID NO: 696 - protein, 61 aa, Leiurus quinquestriatus hebraeus
DGYIKRRDGCKVACLIGNEGCDKECKAYGGSYGYCWTWGLACWCEGLPDDKTWKSETNTCG

SEQ ID NO: 697 - protein, 60 aa, Leiurus quinquestriatus hebraeus
DGYIRGDGCKVSCVINHVFCDNECKAAGGSYGYCWAWGLACWCEGLPAEREWKYETNTCG

SEQ ID NO: 698 - protein, 62 aa, Buthotus judaicus
DGYIRKKDGCKVSCIIGNEGCRKECVAHGGSFGYCWTWGLACWCENLPDAVTWKSSTNTCGR

SEQ ID NO: 699 - protein, 61 aa, Buthacus arenicola
DGYIRRRDGCKVSCLFGNEGCDKECKAYGGSYGYCWTWGLACWCEGLPDDKTWKSETNTCG

SEQ ID NO: 700 - protein, 61 aa, Leiurus quinquestriatus quinquestriatus
DGYIRKRDGCKLSCLFGNEGCNKECKSYGGSYGYCWTWGLACWCEGLPDDKTWKSETNTCG

SEQ ID NO: 701 - protein, 60 aa, Bothus occitanus tunetanus
DGYIKGYKGCKITCVINDDYCDTECKAEGGTYGYCWKWGLACWCEDLPDEKRWKSETNTC

SEQ ID NO: 702 - protein, 63 aa, Leiurus quinquestriatus hebraeus
DNGYLLNKATGCKVWCVINNASCNSECKLRRGNYGYCYFWKLACYCEGAPKSELWAYATNKCN

SEQ ID NO: 703 - protein, 62 aa, Tityus serrulatus
KEGYLMDHEGCKLSCFIRPSGYCGRECGIKKGSSGYCYAWPACYCYGLPNWVKVWDRATNKC

SEQ ID NO: 704 - protein, 64 aa, Tityus zulianus
KDGYLVGNDGCKYSCFTRPGTYCANECSRVKGKDGYCYAWMACYCYSMPNWVKTWDRATNRCGR

SEQ ID NO: 705 - protein, 29 aa, Oldenlandia affinis
GLPVCGETCVGGTCNTPGCTCSWPVCTRN

SEQ ID NO: 706 - protein, 29 aa, Oldenlandia affinis
CGETCFGGTCNTPGCSCTWPICTRDGLPV

SEQ ID NO: 707 - protein, 30 aa, Oldenlandia affinis
GTPCGESCVYIPCISGVIGCSCTDKVCYLN

SEQ ID NO: 708 - protein, 10 aa, Artificial Sequence
  Synthetically Created Peptide
YDPAPPPPPP

SEQ ID NO: 709 - protein, 20 aa, Artificial Sequence
  Synthetically Created Peptide
HHHHHHIEGRYDPAPPPPPP

SEQ ID NO: 710 - protein, 8 aa, Artificial Sequence
  Synthetically created peptide
YDPAPPPP

SEQ ID NO: 711 - protein, 6 aa, Artificial Sequence
  Synthetically Created Peptide
YDPAPP

SEQ ID NO: 712 - protein, 5 aa, Artificial Sequence
  Synthetically Created Peptide
YDPAP

SEQ ID NO: 713 - protein, 6 aa, Artificial Sequence
  Synthetically Created Peptide
YDPAPR

SEQ ID NO: 714 - protein, 4 aa, Artificial Sequence
  Synthetically Created Peptide
YDPA

SEQ ID NO: 715 - protein, 5 aa, Artificial Sequence
  Synthetically Created Peptide
YDPAR

SEQ ID NO: 716 - protein, 20 aa, Artificial Sequence
  Synthetically Created Peptide
YDPARYDPARYDPARYDPAR

SEQ ID NO: 717 - protein, 4 aa, Artificial Sequence
  Synthetically Created Peptide
YDPR

SEQ ID NO: 718 - protein, 4 aa, Artificial Sequence
  Synthetically Created Peptide
DPAR

SEQ ID NO: 719 - protein, 16 aa, Artificial Sequence
  Synthetically Created Peptide
DPARDPARDPARDPAR

SEQ ID NO: 720 - protein, 9 aa, Artificial Sequence
  Synthetically Created Peptide
DPAPPPPPP

SEQ ID NO: 721 - protein, 8 aa, Artificial Sequence
  Synthetically Created Peptide
PAPPPPPP

SEQ ID NO: 722 - protein, 33 aa, Scorpio Maurus
GDCLPHLKLCKENKDCCSKKCKRRGTNIEKRCR

SEQ ID NO: 723 - protein, 64 aa, Mesobuthus eupeus
MSTFVVVFLLLTAILCHAEHAIDETARGCNRLNKKCNSDADCCRYGERCISTGVNYYCRPDVGP

SEQ ID NO: 724 - protein, 85 aa, Atrax robustus
MNTATGFIVLLVLATVLGAIEAEDAVPDFEGGFASHAREDTVGGKIRRSSVCIPSGQPCPYNEHCCSGSCTYKENENGNTVQRCD

SEQ ID NO: 725 - protein, 73 aa, Atrax robustus; identical to SEQ ID NO: 602

SEQ ID NO: 726 - protein, 78 aa, Atrax robustus; identical to SEQ ID NO: 592

SEQ ID NO: 727 - protein, 78 aa, Atrax robustus; identical to SEQ ID NO: 600

SEQ ID NO: 728 - protein, 78 aa, Atrax robustus; identical to SEQ ID NO: 596

SEQ ID NO: 729 - protein, 29 aa, Grammostola rosea
YCQKWLWTCDSERKCCEDMVCRLWCKKRL

SEQ ID NO: 730 - protein, 31 aa, Grammostola rosea
YCQKWMWTCDEERKCCEGLVCRLWCKKKIEW

SEQ ID NO: 731 - protein, 32 aa, Ctenus ornatus
APCTYPGQQCKSDDECCHGTCKTAFIGRICMR

SEQ ID NO: 732 - protein, 86 aa, Chilobrachys jingzhao
MKVSVLITLAVLGVMFVWASAAELEERGSDQRDSPAWLKSMERIFQSGERECRKMFGGCSVDSDCCAHLGCKPTLKYCAWDGTFGK

SEQ ID NO: 733 - protein, 29 aa, Chilobrachys jingzhao
YCQKWMWTCDSERKCCEGYVCELWCKYNL

SEQ ID NO: 734 - protein, 62 aa, Chilobrachys jingzhao
MKTSILFVIFSLALLFALSAATEIEETDRACGQFWWKCGEGKPPCCANFACKIGLYLCIWSP

SEQ ID NO: 735 - protein, 63 aa, Chilobrachys jingzhao
MKNTSILFILGLALLLVLAFEAQVGESDGECGGFWWKCGRGKPPCCKGYACSKTWGWCAVEAP

SEQ ID NO: 736 - protein, 83 aa, Chilobrachys jingzhao
MKASVFAVILGLVVLCACSFAEDEQDQFVSPNELLKSMFVESRHEFTPEVEGRYCQKWMWTCDSKRACCEGLRCKLWCRKIIG

SEQ ID NO: 737 - protein, 31 aa, Grammostola rosea
YCQKWMWTCDEERKCCEGLVCRLWCKRIINM

SEQ ID NO: 738 - protein, 82 aa, Grammostola rosea
MKTSVVFVIAGLALLSVVCYASELKEQSSVNEVLSTIFHFEQPEERGCLEFWWKCNPNDDKCCRPKLKCSKLFKLCNFSFGK

SEQ ID NO: 739 - protein, 69 aa, Agelena orientalis
MRAIISLLLISAMVFSMIEAVPVEEGLQLFEGERGGCLPRNKFCNPSSGPRCCSGLTCKELNIWANKCL

SEQ ID NO: 740 - protein, 69 aa, Agelena orientalis
MRAIISLLLISAMVFSMIEAVPLEEGLQLFEGERGCLPRNKFCNPSSGPRCCSGLTCKELNIWDSRCLG

SEQ ID NO: 741 - protein, 68 aa, Agelena orientalis
MRAIISLLLISAMVFSMIEAVPLEEGLQLFEGERGCLPRNKFCNPSSGPRCCSGLTCKELNIWASKCL

SEQ ID NO: 742 - protein, 69 aa, Agelena orientalis
MRAIISLLLISAMVFSMIEAVPVEEGLQLFEGERGGCLPRNKFCNPSSGPRCCSGLTCKELNIWASKCL

SEQ ID NO: 743 - protein, 68 aa, Agelena orientalis
MKAIISLLLISAMVFSMIEAVPLEEGLQLFEGERGCLPHNRFCNALSGPRCCSGLTCKELNIWASKCL

SEQ ID NO: 744 - protein, 70 aa, Agelena orientalis
MKAIISLLLISAMVFSIIEPVPKKKGLQLSENERGGCLPHNKFCNALSGPRCCSGLKCKELTIWNTKCLE

SEQ ID NO: 745 - protein, 70 aa, Agelena orientalis
MRSIISLILISAMVFSMIAPVPEEERLQLSEDERGGCLPHNRFCNALTGPRCCSRLRCKELSIWDSICLG

SEQ ID NO: 746 - protein, 70 aa, Agelena orientalis
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (24)..(24): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MRAIISLILISAMVFSMIAAVPXXEGLQLSEDERGGCLPHNRFCNALSGPRCCSGLKCKELSIWDSICLG

SEQ ID NO: 747 - protein, 69 aa, Agelena orientalis
MKAIISLLLISAMVFSMFEAVPVRRRFTAFEGERGCLPHNRFCNALSGPRCCTGLKCKELSIWDSRCLG

SEQ ID NO: 748 - protein, 70 aa, Agelena orientalis
MRAIISLLLISAMVFYIIAAVPEEEGLQLSEDERGGCLPHNRFCNALSGPRCCSGLRCKELSIRDSRCLG

SEQ ID NO: 749 - protein, 70 aa, Agelena orientalis
  MISC_FEATURE (25)..(25): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MRAIISLFLISAMVFSMIQAVPEEXGLQLSEDERGGCLPHNRFCNALSGPRCCSGLKCKELSIWDSTCLG

SEQ ID NO: 750 - protein, 70 aa, Agelena orientalis
MRAIISLLLISAMVFSIIEAVPEEEGLQLSEDERGGCLPHNRFCNALSDPRCCSGLRCKELSIWDSRCLG

SEQ ID NO: 751 - protein, 70 aa, Agelena orientalis
MRAIISLLLISAMVFSMIAAVPEEEGLQLSEDERGGCLPHNRFCNALSGPRCCSGLRCKELSIWDSTCLG

SEQ ID NO: 752 - protein, 69 aa, Agelena orientalis
  MISC_FEATURE (24)..(24): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (25)..(25): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MKAIISLLLISAMVFSMIEAVPVXXGLQLFESERGCLPHNRFCNALSGPRCCSRLKCKELSIWDSRCLG

SEQ ID NO: 753 - protein, 69 aa, Agelena orientalis
MKAIISLLLISAMVFSMIEAVPLEEGLQLFEGERGCLPHNTFCNALSGPRCCSGLKCKELSIWDSRCLG

SEQ ID NO: 754 - protein, 69 aa, Agelena orientalis
MKAIISLLLISAMVFSMIEAVPVEEGLQLFEGERGCLPHNRFCNALSGPRCCSGLRCKELSIWDSRCLG

SEQ ID NO: 755 - protein, 70 aa, Agelena orientalis
MRAIISLFLISAMVFSMIQAVPEEKGLQLSEDERGGCLPHNRFCNALSGPRCCSRLKCKELSIWDSRCLG

SEQ ID NO: 756 - protein, 69 aa, Agelena orientalis
MRAIISVLLISAMVFSIIEAVPLEEGLQLFEAERVGCLPRNRFCNALSGPRCCSGLRCKELSIWASKCL

SEQ ID NO: 757 - protein, 70 aa, Agelena orientalis
MRAIIYLLLISAMVFSMTKAVPEEEGLQLSEDERGGCLPHNRFCNALSGPRCCSGLKCKELSIYDSRCLG

SEQ ID NO: 758 - protein, 69 aa, Agelena orientalis
MKAIISLLLISAMVFSMIEAVPVEEGLQLFEGERGCLPHNRFCNALSGPRCCSGLKCKELSIWDSRCLG

SEQ ID NO: 759 - protein, 70 aa, Agelena orientalis
MRAIISLILISAMVFSMIAAVPEEEGLQLSEDERGGCLPHNRFCNALSGPRCCSGLRCKELSIWDSRCLG

SEQ ID NO: 760 - protein, 33 aa, Phoneutria nigriventer
VFCRFNGQQCTSDGQCCYGKCRTAFLRMICMGG

SEQ ID NO: 761 - protein, 43 aa, Agelenopsis aperta
  MISC_FEATURE (20)..(20): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (40)..(40): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
NCIDFGGDCDGEKDDCQCCXRNGYCSCYNLFGYLKRGCKXEVG

SEQ ID NO: 762 - protein, 39 aa, Missulena bradleyi
SPVCTPSGQPCQPNTQPCCNNAEEEQTINCNGNTVYRCA

SEQ ID NO: 763 - protein, 36 aa, Hadronyche infensa; identical to SEQ ID NO: 615

SEQ ID NO: 764 - protein, 37 aa, Hadronyche versuta; identical to SEQ ID NO: 24

SEQ ID NO: 765 - protein, 37 aa, Hadronyche formidabilis; identical to SEQ ID NO: 631

SEQ ID NO: 766 - protein, 37 aa, Hadronyche infensa; identical to SEQ ID NO: 609

SEQ ID NO: 767 - protein, 37 aa, Hadronyche versuta
SSTCIPSGQPCPYNENCCSQSCTYKENENGNTVKRCD

SEQ ID NO: 768 - protein, 37 aa, Hadronyche infensa; identical to SEQ ID NO: 613

SEQ ID NO: 769 - protein, 37 aa, Hadronyche versuta
SSTCIPSGQPCPYNENCCSQSCTFKENENGNTVKRCD

SEQ ID NO: 770 - protein, 37 aa, Hadronyche versuta; identical to SEQ ID NO: 601

SEQ ID NO: 771 - protein, 37 aa, Hadronyche versuta
SPTCIPSGQPCPYNENCCSQSCTYKENENGNTVKRCD

SEQ ID NO: 772 - protein, 37 aa, Hadronyche versuta
SAVCIPSGQPCPYSKYCCSGSCTYKTNENGNSVQRCD

SEQ ID NO: 773 - protein, 45 aa, Hadronyche versuta; identical to SEQ ID NO: 589

SEQ ID NO: 774 - protein, 32 aa, Phoneutria nigriventer
VFCRSNGQQCTSDGQCCYGKCMTAFMGKICMR

SEQ ID NO: 775 - protein, 32 aa, Phoneutria reidyi
AFCRFNGQQCTSDGQCCNGRCINAFQGRICIG

SEQ ID NO: 776 - protein, 33 aa, Ceratogyrus marshalli
DCLGWFKSCDPKNDKCCKNYTCSRRDRWCKYDL

SEQ ID NO: 777 - protein, 39 aa, Aphonopelma sp
IFECVFSCDIEKEGKPCKPKGEKKCTGGWKCKIKLCLKI

SEQ ID NO: 778 - protein, 29 aa, Grammostola rosea
YCQKWMWTCDSKRKCCEDMVCQLWCKKRL

SEQ ID NO: 779 - protein, 35 aa, Heteroscodra maculata
ECRYLFGGCSSTSDCCKHLSCRSDWKYCAWDGTFS

SEQ ID NO: 780 - protein, 35 aa, Psalmopoeus cambridgei
SECRWFMGGCDSTLDCCKHLSCKMGLYYCAWDGTF

SEQ ID NO: 781 - protein, 34 aa, Stromatopelma calceatum griseipes
TCRYLFGGCKTTADCCKHLACRSDGKYCAWDGTF

SEQ ID NO: 782 - protein, 34 aa, Stromatopelma calceatum
DCTRMFGACRRDSDCCPHLGCKPTSKYCAWDGTI

SEQ ID NO: 783 - protein, 35 aa, Theraphosa blondi
AACLGMFESCDPNNDKCCPNRECNRKHKWCKYKLW

SEQ ID NO: 784 - protein, 32 aa, Phoneutria keyserlingi
AFCKYNGEQCTSDGQCCNGRCRTAFMGKICMG

SEQ ID NO: 785 - protein, 35 aa, Phoneutria nigriventer
MPCPKILKQCKSDEDCCRGWKCFGFSIKDKMCISR

SEQ ID NO: 786 - protein, 40 aa, Phoneutria reidyi
ECADVYKEVWYPEKPCCKDRACQCSLGMNCKCKATLGDIF

SEQ ID NO: 787 - protein, 31 aa, Phoneutria nigriventer
VFCRFNGQQCTSDGQCCYGKCRTAFMGKICM

SEQ ID NO: 788 - protein, 36 aa, Phoneutria nigriventer
IACAPRFSLCNSDKECCKGLRCKSRIANMWPTFCSQ

SEQ ID NO: 789 - protein, 36 aa, Phoneutria reidyi
IACAPRGLLCFRDKECCKGLTCKGRFVNTWPTFCLV

SEQ ID NO: 790 - protein, 32 aa, Phoneutria nigriventer
SFCIPFKPCKSDENCCKKFKCKTTGIVKLCRW

SEQ ID NO: 791 - protein, 33 aa, Ceratogyrus marshalli
DCLGWFKSCDPKNDKCCKNYTCSRRDRWCKYYL

SEQ ID NO: 792 - protein, 39 aa, Aphonopelma sp
IFECVFSCDIEKEGKPCKPKGEKKCSGGWKCKIKLCLKI

SEQ ID NO: 793 - protein, 38 aa, Heteroscodra maculata
ECRYFWGECNDEMVCCEHLVCKEKWPITYKICVWDRTF

SEQ ID NO: 794 - protein, 35 aa, Psalmopoeus cambridgei
GACRWFLGGCKSTSDCCEHLSCKMGLDYCAWDGTF

SEQ ID NO: 795 - protein, 35 aa, Theraphosa blondi
DDCLGMFSSCDPKNDKCCPNRVCRSRDQWCKYKLW

SEQ ID NO: 796 - protein, 36 aa, Phoneutria keyserlingi
IACAPRGQLCFSDKLCCIGLRCKSRVANMWPTFCLV

SEQ ID NO: 797 - protein, 34 aa, Phoneutria nigriventer
  MISC_FEATURE (31)..(31): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
GCANAYKSCNGPHTCCWGYNGYKKACICSGXNWK

SEQ ID NO: 798 - protein, 39 aa, Ceratogyrus marshalli
GVDKEGCRKLLGGCTIDDDCCPHLGCNKKYWHCGWDGTF

SEQ ID NO: 799 - protein, 34 aa, Paraphysa scrofa
DCLGFLWKCNPSNDKCCRPNLVCSRKDKWCKYQI

SEQ ID NO: 800 - protein, 34 aa, Psalmopoeus cambridgei
ECRWYLGGCKEDSECCEHLQCHSYWEWCLWDGSF

SEQ ID NO: 801 - protein, 35 aa, Theraphosa blondi
DDCLGMFSSCDPNNDKCCPNRVCRVRDQWCKYKLW

SEQ ID NO: 802 - protein, 41 aa, Hysterocrates gigas
GVDKAGCRYMFGGCSVNDDCCPRLGCHSLFSYCAWDLTFSD

SEQ ID NO: 803 - protein, 37 aa, Heteropoda venatoria
DDDCGWIMDDCTSDSDCCPNWVCSKTGFVKNICKYEM

SEQ ID NO: 804 - protein, 36 aa, Heteropoda venatoria
ADCGWLFHSCESNADCCENWACATTGRFRYLCKYQI

SEQ ID NO: 805 - protein, 35 aa, Agelena orientalis
GGCLPHNRFCNALSGPRCCSGLKCKELSIWDSRCL

SEQ ID NO: 806 - protein, 70 aa, Agelena orientalis
MRAIISLFLISAMVFSMIQAVPEEEGLQLSEDERGGCLPHNRFCNALSGPRCCSGLKCKELSIWDSRCLG

SEQ ID NO: 807 - protein, 88 aa, Latrodectus tredecimguttatus
MSKLFFVVFLCLIISVFAISPADIGCTDISQADFDEKNNNCIKCGEDGFGEEMVNRCRDKCFTDNFYQSCVDLLNKVYEEKDTPPVQE

SEQ ID NO: 808 - protein, 33 aa, Phoneutria nigriventer
GFCAQKGIKCHDIHCCTNLKCVREGSNRVCRKA

SEQ ID NO: 809 - protein, 86 aa, Psalmopoeus cambridgei
MMRVLIVTAVFTFFLVLTSSGHDEDNEQRNILEGMFLDRAIETPKGLEEKRACGILHDNCVYVPAQNPCCRGLQCRYGKCLVQVGR

SEQ ID NO: 810 - protein, 65 aa, Psalmopoeus cambridgei
MGFKLVLFIAVLTLVGSSNAEISAKMDSRDSPMIQERRCLPAGKTCVRGPMRVPCCGSCSQNKCT

SEQ ID NO: 811 - protein, 36 aa, Plesiophrictus guangxiensis
DGECGGFWWKCGSGKPACCPKYVCSPKWGLCNFPMP

SEQ ID NO: 812 - protein, 36 aa, Plesiophrictus guangxiensis
EGECGGFWWKCGSGKPACCPKYVCSPKWGLCNFPMP

SEQ ID NO: 813 - protein, 33 aa, Plesiophrictus guangxiensis
ECRKMFGGCSVDSDCCAHLGCKPTLKYCAWDGT

SEQ ID NO: 814 - protein, 68 aa, Haplopelma huwenum
MNMKILVLVAVLCLVVSTHAERHSKTDMEDMEDSPMIQERKCLPPGKPCYGATQKIPCCGVCSHNKCT

SEQ ID NO: 815 - protein, 55 aa, Haplopelma huwenum
IDTCRLPSDRGRCKASFERWYFNGRTCAKFIYGGCGGNGNKFPTQEACMKRCAKA

SEQ ID NO: 816 - protein, 81 aa, Haplopelma huwenum
MRASMFLALAGLVLLFVVCYASESEEKEFPRELLFKFFAVDDFKGEERACKGVFDACTPGKNECCPNRVCSDKHKWCKWKL

SEQ ID NO: 817 - protein, 85 aa, Haplopelma huwenum
MKVTLIAILTCAAVLVLHTTAAEELEAESQLMEVGMPDTELAAVDEERLFECSFSCEIEKEGDKPCKKKKCKGGWKCKFNMCVKV

SEQ ID NO: 818 - protein, 37 aa, Haplopelma huwenum
LFECSFSCEQEKEGDKPCKKKKCKGGWKCKFNMCVKV

SEQ ID NO: 819 - protein, 87 aa, Haplopelma huwenum
MVNMKASMFLTFAGLVLLFVVCYASESEEKEFPKEMLSSIFAVDNDFKQEERDCAGYMRECKEKLCCSGYVCSSRWKWCVLPAPWRR

SEQ ID NO: 820 - protein, 89 aa, Haplopelma huwenum
MVNMKASMFLALAGLVLLFVVCYASESEEKEFSNELLSSVLAVDDNSKGEERECLEIFKACNPSNDQCCKSSKLVCSRKTRWCKYQIGK

SEQ ID NO: 821 - protein, 86 aa, Haplopelma huwenum
MKSIVFVALFGLALLAVVCSASEDAHKELLKEVVRAMVVDKTDAVQAEERECRWYLGGCSQDGDCCKHLQCHSNYEWCVWDGTFSK

SEQ ID NO: 822 - protein, 41 aa, Haplopelma huwenum
NCIGEQVPCDENDPRCCSGLVVLKKTLHGIWIKSSYCYKCK

SEQ ID NO: 823 - protein, 83 aa, Haplopelma huwenum
MKVTLIAILTCAAVLVLHTTAAEELEESQLMEVGMPDTELAAVDEERLFECSISCEIEKKGESCKPKKCKGGWKCKFNMCVKV

SEQ ID NO: 824 - protein, 34 aa, Haplopelma huwenum
IICAPEGGPCVAGIGCCAGLRCSGAKLGLAGSCQ

SEQ ID NO: 825 - protein, 33 aa, Haplopelma hainanum
ECKGFGKSCVPGKNECCSGYACNSRDKWCKVLL

SEQ ID NO: 826 - protein, 33 aa, Haplopelma hainanum
GCKGFGDSCTPGKNECCPNYACSSKHKWCKVYL

SEQ ID NO: 827 - protein, 35 aa, Haplopelma hainanum
ECLGFGKGCNPSNDQCCKSSNLVCSRKHRWCKYEI

SEQ ID NO: 828 - protein, 35 aa, Haplopelma hainanum
ECLGFGKGCNPSNDQCCKSANLVCSRKHRWCKYEI

SEQ ID NO: 829 - protein, 35 aa, Grammostola rosea
ECRYLFGGCKTTSDCCKHLGCKFRDKYCAWDFTFS

SEQ ID NO: 830 - protein, 35 aa, Grammostola rosea
ECRYLFGGCKTTADCCKHLGCKFRDKYCAWDFTFS

SEQ ID NO: 831 - protein, 33 aa, Heteropoda venatoria
DCGTIWHYCGTDQSECCEGWKCSRQLCKYVIDW

SEQ ID NO: 832 - protein, 30 aa, Heteropoda venatoria
DDCGKLFSGCDTNADCCEGYVCRLWCKLDW

SEQ ID NO: 833 - protein, 31 aa, Heteropoda venatoria
ECGTLFSGCSTHADCCEGFICKLWCRYERTW

SEQ ID NO: 834 - protein, 29 aa, Heteropoda venatoria
DDCGTLFSGCDTSKDCCEGYVCHLWCKYK

SEQ ID NO: 835 - protein, 83 aa, Haplopelma huwenum
MKTSMFLTLTGLGLLFVVCYASESEEKEFPKELLSSIFAADSDFKVEERGCLGDKCDYNNGCCSGYVCSRTWKWCVLAGPWRR

SEQ ID NO: 836 - protein, 77 aa, Macrothele gigas
MKVFSFTVVVVMILSLSAFVLAGDEGDVMKKIVAMEEAVEERACLAEYQKCEGSTVPCCPGLSCSAGRFRKTKLCTK

SEQ ID NO: 837 - protein, 81 aa, Macrothele gigas
MKAPATIVILIMSLISVLWATADTEDGNLLFPIEDFIRKFDEYPVQPKERSCKLTFWRCKKDKECCGWNICTGLCIPPGKK

SEQ ID NO: 838 - protein, 38 aa, Macrothele gigas
CMGYDIHCTDRLPCCFGLECVKTSGYWWYKKTYCRRKS

SEQ ID NO: 839 - protein, 121 aa, Macrothele gigas
MMTLSPFLLLLIAAVVIGNASEGEVKNEFEERLKDEFKDPSRSEVAEVILLRELEVLEETLFGKEMTSDTEENRNSREKRCMGYDIECNENLPCCKHRKLECVETSGYWWYKRKYCRPIKG

SEQ ID NO: 840 - protein, 79 aa, Macrothele gigas
MKAPATTLILVMSLISVLWATPDLEEGDLLAELGDLIATDDEYPMKPEERGCKLTFWKCKNKKECCGWNACALGICMPR

SEQ ID NO: 841 - protein, 77 aa, Macrothele gigas
MKVFSFTIGLVVIISLFAFALAYDEETDLMKKLVEMERAIEQRIICAPEGGPCVVGIGCCKGYSCAPGLLGLVGHCQ

SEQ ID NO: 842 - protein, 81 aa, Macrothele gigas
MKYVMVILGLLVLAAICCASEVEELDWRQEIARAILEAELQPEERDCKGLFRQCKKSSECCKGSSCESDLTGLCIFNLPGR

SEQ ID NO: 843 - protein, 80 aa, Macrothele gigas
MKFATFAFTLCVVISLSVLVLADEEEKDFLMNLIQPLKESEERQFCGTNGKPCVNGQCCGALRCVVTYHYADGVCLKMNP

SEQ ID NO: 844 - protein, 39 aa, Brachypelma albiceps
ILECVFSCDIKKEGKPCKPKGEKKCTGGWRCKIKLCLKI

SEQ ID NO: 845 - protein, 39 aa, Brachypelma smithi; identical to SEQ ID NO: 792

SEQ ID NO: 846 - protein, 29 aa, Paraphysa scrofa
YCQKWMWTCDSARKCCEGLVCRLWCKKII

SEQ ID NO: 847 - protein, 40 aa, Psalmopoeus cambridgei
EDCIPKWKGCVNRHGDCCEGLECWKRRRSFEVCVPKTPKT

SEQ ID NO: 848 - protein, 39 aa, Brachypelma albiceps
IFECVFSCDIKKEGKPCKPKGEKKCTGGWRCKIKLCLKI

SEQ ID NO: 849 - protein, 31 aa, Paraphysa scrofa; identical to SEQ ID NO: 737

SEQ ID NO: 850 - protein, 34 aa, Brachypelma smithi
SCVDFQTKCKKDSDCCGKLECSSRWKWCVYPSPF

SEQ ID NO: 851 - protein, 32 aa, Apomastus schleringi
WLGCARVKEACGPWEWPCCSGLKCDGSECHPQ

SEQ ID NO: 852 - protein, 35 aa, Thrixopelma pruriens
ECRYWLGGCSAGQTCCKHLVCSRRHGWCVWDGTFS

SEQ ID NO: 853 - protein, 30 aa, Thrixopelma pruriens
YCQKWMWTCDSERKCCEGMVCRLWCKKKLW

SEQ ID NO: 854 - protein, 99 aa, Macrothele gigas
TSQGTTPDKVQLEVNCISNLPNNEVEETDLLRELEMIEENLFGKELSFVPEENRNSRHKRCMGYDIECNERLHCCADLECVKTSGRWWYKKTYCRRKSG

SEQ ID NO: 855 - protein, 29 aa, Macrothele raveni
GCKLTFWKCKNKKECCGWNACALGICMPR

SEQ ID NO: 856 - protein, 30 aa, Heteropoda venatoria
DDCGGLFSGCDSNADCCEGYVCRLWCKYKL

SEQ ID NO: 857 - protein, 31 aa, Coremiocnemis valida
ACSRAGENCYKSGRCCDGLYCKAYVVTCYKP

SEQ ID NO: 858 - protein, 34 aa, Grammostola rosea
ECGKFMWKCKNSNDCCKDLVCSSRWKWCVLASPF

SEQ ID NO: 859 - protein, 32 aa, Grammostola rosea
YCQKWMWTCDEERKCCEGLVCRLWCKKKIEEG

SEQ ID NO: 860 - protein, 34 aa, Grammostola rosea
DCLGWFKGCDPDNDKCCEGYKCNRRDKWCKYKLW

SEQ ID NO: 861 - protein, 36 aa, Grammostola rosea
DCVRFWGKCSQTSDCCPHLACKSKWPRNICVWDGSV

SEQ ID NO: 862 - protein, 85 aa, Haplopelma huwenum
MKVTLIAILTCAAVLVLHTTAAEELEAESQLMEVGMPDTELAAVDEERPFECSFSCEIEKEGDKPCKKKKCKGGWKCKFNMCVKV

SEQ ID NO: 863 - protein, 88 aa, Haplopelma huwenum
MGIARILSAVLFLSVLFVVTFPALLSADHHDGRIDTCRLPSDRGRCKASFERWYFNGRTCAKFIYGGCGGNGNKFPTQEACMKRCGKA

SEQ ID NO: 864 - protein, 99 aa, Lasiodora sp
MNTIQVIIFAVVLVLTVTVGQADEDSPEASLLRKLKEAEASLFGQNLEESRNSRQKRCGGVDAPCDKDRPDCCSYAECLRPSGYGWWHGTYYCYRKRER

SEQ ID NO: 865 - protein, 81 aa, Haplopelma huwenum
MKASMFLALAGLVLLFVVCYASESEEKEFPRELLSKIFAVDDFKGEERACKGVFDACTPGKNECCSNRVCSDKHKWCKWKL

SEQ ID NO: 866 - protein, 102 aa, Hadronyche infensa
MKFSKLSLTLALILTQAIFVLCGKINEDFMENGLESHALHDEIRKPIDTEKADAERGVVDCVLNTLGCSSDKDCCGMTPSCTLGICAPSVGGLVGGLLGRAL

SEQ ID NO: 867 - protein, 102 aa, Hadronyche infensa
MKFSKLSLTLALILTQALLVVCGKINEDFMENGLESHALHDEIRKPIDTEKADAERGVLDCVVNTLGCSSDKDCCGMTPSCTLGICAPSVGGIVGGLLGRAL

SEQ ID NO: 868 - protein, 99 aa, Brachypelma smithi
MNTIQVIIFAVVLVLTVTVGQADEDSAETSLLRKLEEAEAAMFGQYLEESKNSREKRCIGESVPCDKDDPRCCREYECLKPTGYGWWYASYYCYRKKSG

SEQ ID NO: 869 - protein, 81 aa, Haplopelma huwenum
MKASMFLAFAGLVLLFVVCYASESEEKEFPRELISKIFAVDDFKGEERACKGVFGACTPGKNECCPNRVCSDKHKWCKWKL

SEQ ID NO: 870 - protein, 84 aa, Haplopelma huwenum
MKVTLIAILTCAAVLVLHTTAAEELEAESQLMEVGMPDTELAAVDEERLFECSISCEIEKKGESCKPKECKGGWKCKFNMCVKV

SEQ ID NO: 871 - protein, 83 aa, Haplopelma huwenum
MKTSMFLTLTGLVLLFVVCYASESEEKEFPKELLSSIFAADSDFKEEERGCFGYKCDYYKGCCSGYVCSPTWKWCVRPGPGRR

SEQ ID NO: 872 - protein, 85 aa, Haplopelma huwenum
MKVTLIAILTCAAVLVLHTTAAEELEAESQLMEVGMPDTELAAVDEERLFECSFSCEIEKEGDKLCKKKKCKGGWKCKFNMCVKV

SEQ ID NO: 873 - protein, 88 aa, Latrodectus tredecimguttatus
MLKLICIAFLVTVLTLVAGQDSLDPAEFGCADDVNQAELLKNNDICLQCEDLHKEGVVFSLCKTNCFTTEYFQHCVKDLEEAKKEPPE

SEQ ID NO: 874 - protein, 37 aa, Atrax robustus; identical to SEQ ID NO: 627

SEQ ID NO: 875 - protein, 76 aa, Atrax robustus; identical to SEQ ID NO: 582

SEQ ID NO: 876 - protein, 78 aa, Atrax robustus; identical to SEQ ID NO: 594

SEQ ID NO: 877 - protein, 39 aa, Brachypelma smithi
IIECVFSCDIEKEGKPCKPKGEKKCSGGWKCKIKLCLKI

SEQ ID NO: 878 - protein, 83 aa, Hadronyche venenata
MNTATGVIALLVLATVIGCIEAETRADLQGAFESYEGEAAEKIFRRSPTCIPSGQPCPYNENCCSKSCTYKEMKTATPVQRCD

SEQ ID NO: 879 - protein, 84 aa, Hadronyche venenata
MNTATGVIALVVLATVIGCIEAEETRADLQGAFESYEGEAADKIFRRSPTCIPSGQPCPYNENCCSKSCTYKENENGNTVQRCD

SEQ ID NO: 880 - protein, 84 aa, Hadronyche venenata
MNTATGVIALLVLATVIGCIEAEETRADLQGAFESYEGEGADKIFRRSPTCIPSGQPCPYNENCCSKSCTYKENENGNTVQRCD

SEQ ID NO: 881 - protein, 84 aa, Hadronyche venenata
MNTATGVIALLVLATVIGCIEVEETRADLQGAFESYEGEAAEKIFRRSPTCIPSGQPCPYNENCCSKSCTYKENENGNTVQRCD

SEQ ID NO: 882 - protein, 84 aa, Hadronyche venenata
MNTATGVIALLVLATVIGCIEAEETRADLQGAFESYEGEAADKIFRRSPTCIPSGQPCPYNENCCSKSCTYKENENGNTVQRCD

SEQ ID NO: 883 - protein, 84 aa, Hadronyche venenata
MNTATGVIALLVLATVIGCIEAEDTRADLQGGLESYEGEAADKIFRRSPTCIPSGQPCPYNENCCSKSCTYKENENGNTVQRCD

SEQ ID NO: 884 - protein, 76 aa, Hadronyche versuta; identical to SEQ ID NO: 582

SEQ ID NO: 885 - protein, 76 aa, Hadronyche versuta; identical to SEQ ID NO: 580

SEQ ID NO: 886 - protein, 76 aa, Hadronyche versuta; identical to SEQ ID NO: 584

SEQ ID NO: 887 - protein, 65 aa, Haplopelma huwenum
MNMKILVLVAVLCLVVSTHAERHSKTDMEDSPMIQERKCLPPGKPCYGATQKIPCCGVCSHNKCT

SEQ ID NO: 888 - protein, 32 aa, Haplopelma huwenum
DCAGYMRECKEKLCCSGYVCSSRWKWCVLPAP

SEQ ID NO: 889 - protein, 33 aa, Haplopelma huwenum
ECRWYLGGCSQDGDCCKHLQCHSNYEWCVWDGT

SEQ ID NO: 890 - protein, 83 aa, Haplopelma huwenum
MKTSMFLTLTGLVLLFVVCYASESEEKDFPKELLSSIFAADSDFKVEERGCLGDKCDYNNGCCSGYVCSRTWKWCVLAGPWRR

SEQ ID NO: 891 - protein, 81 aa, Haplopelma huwenum
MKASMFLTFAGLVLLFVVCYASESEEKEFPRELISKIFAVDDFKGEERACKGVFDACTPGKNECCPNRVCSDKHKWCKWKL

SEQ ID NO: 892 - protein, 81 aa, Haplopelma huwenum
MKASMFLAFAGLALLFVVCYASESEEKEFPRELISKIFAVDDFKGEERACKGVFDACTPGKNECCPNRVCSDKHKWCKWKL

SEQ ID NO: 893 - protein, 81 aa, Haplopelma huwenum
MKASMFLAFAGLVLLFVVCYASESEEKEFPRELISKIFAVDDFKGEERACKGVFDACTPGKNECCPNRVCSDKHKWCKWKL

SEQ ID NO: 894 - protein, 81 aa, Haplopelma huwenum
MEASMFLAFAGLVLLFVVCYASESEEKEFPRELISKIFAVDDFKGEERACKGVFDACTPGKNECCPNRVCSDKHKWCKWKL

SEQ ID NO: 895 - protein, 81 aa, Haplopelma huwenum
MKASMFLAFAGLVLLFVVCYASESEEKELPRELLSKIFAVDDFKGEERACKGVFDACTPGKNECCPNRVCSDKHKWCKWKL

SEQ ID NO: 896 - protein, 81 aa, Haplopelma huwenum
MKASMFLALAGLVLLFVVCYASESEEKEFPRELLSKIFAVDDFKGEERACKGVFDACTPGKNECCPNRVCSDKHKWCKWKL

SEQ ID NO: 897 - protein, 83 aa, Haplopelma huwenum; identical to SEQ ID NO: 890

SEQ ID NO: 898 - protein, 83 aa, Haplopelma huwenum
MKTSMFLTLTGLVLLFVDCYASESEEKEFPKELLSSIFAADSDFKVEERGCLGDKCDYNNGCCSGYVCSRTWKWCVLAGPWRR

SEQ ID NO: 899 - protein, 83 aa, Haplopelma huwenum
MKTSMFLTLTGLVLLFVVCYASESEEKEFPKELPSSIFAADSDFKVEERGCLGDKCDYNNGCCSGYVCSRTWKWCVLAGPWRR

SEQ ID NO: 900 - protein, 83 aa, Haplopelma huwenum
MKTSMFLTLTGLVLLFVVCYASESEEKEFPKELLSSIFAADSDFKVEERGCLGDKCDYNNGCCSGYVCSRTWKWCVLAGPWRR

SEQ ID NO: 901 - protein, 83 aa, Haplopelma huwenum
MQTSMFLTLTGLVLLFVVCYASESEEKEFPKELLSSIFAADSDFKEEERGCFGYKCDYYKGCCSGYVCSPTWKWCVRPGPGRR

SEQ ID NO: 902 - protein, 83 aa, Haplopelma huwenum
MKTSMFLTLTGLVLLFVVCYASESEEKEFPKELLSSIFAADSDFKVEERGCLGDKCDYNNGCCSGYVCSRTWKWCVLAGPWCR

SEQ ID NO: 903 - protein, 83 aa, Haplopelma huwenum
MKTSMFLTLTGLVLLFVVCYASESEEKEFPKELLSSIFAADSDFKVEERGCLGDKCDYNNGCCSGYVCPRTWKWCVLAGPWRR

SEQ ID NO: 904 - protein, 84 aa, Haplopelma huwenum
MKVTLIAILTCAAVLVLHTTAAEELEESQLMEVGMPDTELAAVDEERLFECSFSCEIEKEGDKPCKKKKCKGGWKCKFNMCVKV

SEQ ID NO: 905 - protein, 85 aa, Haplopelma huwenum
MKVTLIAILTCAAVLVLHTTAAEELEAESQLMEVGMPDTESAAVDEERLFECSFSCEIEKEGDKPCKKKKCKGGWKCKFNMCVKV

SEQ ID NO: 906 - protein, 84 aa, Haplopelma huwenum
MKVTLIAILTCAAVLVLHTTAAEELEESQLMEVGMPDTELAAVDEERPFECSFSCEIEKEGDKPCKKKKCKGGWKCKFNMCVKV

SEQ ID NO: 907 - protein, 84 aa, Haplopelma huwenum
MKVTLIAFLTCAAVLVLHTTAAEELEAESQLMEVGMPDTELAAVDEERLFECSISCEIEKKGESCKPKKCKGGWKCKFNMCVKV

SEQ ID NO: 908 - protein, 84 aa, Haplopelma huwenum
MKVTLIAILTCAAVLVLHTTAAEELEAESQLMEVGMPDTELAAVDEERLFECSISCEIEKKGESCKPKKCKGGWKCKFNMCVKV

SEQ ID NO: 909 - protein, 83 aa, Haplopelma huwenum; identical to SEQ ID NO: 823

SEQ ID NO: 910 - protein, 88 aa, Haplopelma huwenum
MGIARILSAVLFLSVLFVVTFPALLSADHRDGRIDTCRLPSDRGRCKASFERWYFNGRTCAKFIYGGCGGNGNKFPTQEACMKRCAKA

SEQ ID NO: 911 - protein, 85 aa, Haplopelma huwenum
MKVTLIAILTCAAVLVLHTTAAEELEAESQLMEVGMPDTELAAVDEERLFECSFSCEIEKEGDKPCKKKKCKGGWKCKFNMCVKF

SEQ ID NO: 912 - protein, 88 aa, Haplopelma huwenum
MGIARILSAVLFLSVLFVVTFPALLSADHHDGRIDTCRLPSDRGRCKASFERWYFNGRTCAKFIYGGCGGNGNKFPTQEACMKRCAKA

SEQ ID NO: 913 - protein, 78 aa, Hadronyche infensa; identical to SEQ ID NO: 614

SEQ ID NO: 914 - protein, 78 aa, Hadronyche infensa; identical to SEQ ID NO: 620

SEQ ID NO: 915 - protein, 79 aa, Hadronyche infensa; identical to SEQ ID NO: 608

SEQ ID NO: 916 - protein, 79 aa, Hadronyche infensa; identical to SEQ ID NO: 610

SEQ ID NO: 917 - protein, 79 aa, Hadronyche infensa
MNTATGFIVLLVLATVIGCISTDFQGGFEPYEEEDAERIFRRSPTCIPTGQPCPYNENCCSQSCTYKANENGNQVKRCD

SEQ ID NO: 918 - protein, 79 aa, Hadronyche infensa
MNTATGFIVLLVLATVIGCISADFQGGFEPYEEEDAQRIFRRSPTCIPTGQPCPYNENCCSQSCTYKANENGNQVKRCD

SEQ ID NO: 919 - protein, 78 aa, Hadronyche infensa; identical to SEQ ID NO: 612

SEQ ID NO: 920 - protein, 79 aa, Hadronyche infensa; identical to SEQ ID NO: 606

SEQ ID NO: 921 - protein, 79 aa, Hadronyche infensa; identical to SEQ ID NO: 604

SEQ ID NO: 922 - protein, 79 aa, Hadronyche infensa
MNTATGFIVLLVLATVIGCISADFQGGFEPYEEEDAERIFRRSPTCIPTGQPCPYNENCCSQSCTYKTNENGNQVKGCD

SEQ ID NO: 923 - protein, 78 aa, Hadronyche infensa; identical to SEQ ID NO: 616

SEQ ID NO: 924 - protein, 78 aa, Hadronyche infensa; identical to SEQ ID NO: 622

SEQ ID NO: 925 - protein, 78 aa, Hadronyche infensa; identical to SEQ ID NO: 618

SEQ ID NO: 926 - protein, 37 aa, Heriaeus melloteei
GCIPYGKTCEFWSGPWCCAGKCKLNVWSMTLSCTRNF

SEQ ID NO: 927 - protein, 40 aa, Heriaeus melloteei
GCIPSFGECAWFSGESCCTGICKWVFFTSKFMCRRVWGKD

SEQ ID NO: 928 - protein, 35 aa, Agelena orientalis
KGCLPRNRFCNALSGPRCCSGLRCKELSIWASKCL

SEQ ID NO: 929 - protein, 35 aa, Agelena orientalis
GGCLPHNRFCNALSGPRCCSGLTCKELNIWASKCL

SEQ ID NO: 930 - protein, 29 aa, Eucratoscelus constrictus
YCQKFLWTCDTERKCCEDMVCELWCKLEK

SEQ ID NO: 931 - protein, 86 aa, Haplopelma huwenum
MKASMFLALAGLVLLFVVCYASESEEKEFSNELLSSVLAVDDNSKGEERECLEIFKACNPSNDQCCKSSKLVCSRKTRWCKYQIGK

SEQ ID NO: 932 - protein, 86 aa, Haplopelma huwenum
MKASMFLALAGLVQLFVVCYASESEEKEFSNELLSSVLAVDDNSKGEERECLEIFKACNPSNDQCCKSSKLVCSRKTRWCKYQIGK

SEQ ID NO: 933 - protein, 81 aa, Haplopelma huwenum
MKASMFLAFAGLVLLFVVCYASESEEKEFPRELISKIFAVDDFKGEERACKGVFDACTPGKNECCPNRVCSDEHKWCKWKL

SEQ ID NO: 934 - protein, 86 aa, Chilobrachys jingzhao
MKVSLLITLAVLGVMFVWASAAELQERGSDQKDSPAWLKSMERIFQSEERECKKMFGGCTVHSDCCAHLGCKPTLKYCAWDGTFGK

SEQ ID NO: 935 - protein, 83 aa, Chilobrachys jingzhao
MKGSAFAIILGLVVLCACSFAEDEQDQFASPNELLRSMFLESRHELIPEVEGRYCQKWMWTCDSERKCCEGYVCELWCKYNMG

SEQ ID NO: 936 - protein, 63 aa, Chilobrachys jingzhao
MKNTSILFILGLALLLVLAFEVQVGESDGECGGFWWKCGSGKPACCPKYVCSPKWGLCNFPMP

SEQ ID NO: 937 - protein, 86 aa, Chilobrachys jingzhao
MKVSVLITLAVLGVMFVWASAAELEERGSDHRDSPAWLKSMERIFQSEERECRKMFGGCSVHSDCCAHLGCKPTLKYCAWDGTFGK

SEQ ID NO: 938 - protein, 77 aa, Chilobrachys jingzhao
MKTSVLLVILGIAAITVQCTASESVEQDSLRTFVDTVLGWNAEMASEARCGGWMAKCADSDDCCETFHCTRFNVCGK

SEQ ID NO: 939 - protein, 77 aa, Chilobrachys jingzhao
MKTSVLLVILGIAAITVQCTASESVEQDSLRTFVDAVLGWNAEMASEARCGGWMAKCADSDDCCETFHCTRFNVCGK

SEQ ID NO: 940 - protein, 77 aa, Chilobrachys jingzhao
MKTSVLLVILGIAAITVQCTASESVEQDSLRTFVDAVLGWNAEMASEARCGGWMAKCADSDDCCEAFHCTRFNVCGK

SEQ ID NO: 941 - protein, 77 aa, Chilobrachys jingzhao
MNTSDPPAVLRIAAITLLCTASESVEQNPLIPFENAVLGSYAKMASEKRCDGWMAKCPDRDDCCETFHCTRFNARGN

SEQ ID NO: 942 - protein, 87 aa, Chilobrachys jingzhao
MKVLVLITLAVLGAMFVWTSAAELEERGSDQRDSPAWVKSMERIFQSEERACREWLGGCSKDADCCAHLECRKKWPYHCVWDWTVRK

SEQ ID NO: 943 - protein, 78 aa, Chilobrachys jingzhao
MKTSVLVTVLGLAVISVLCSASQDEEQDMYDELLSAVFEVNDELQSEARCGEKNDRCKTNQDCCSGFRCTKFRRCGRR

SEQ ID NO: 944 - protein, 85 aa, Chilobrachys jingzhao
MKVSVLITLAVLGVMFVWASAAELEERGSDQRDSPAWLKSMERIFQSEERECRKMFGGCSVDSDCCAHLGCKPTLKYCAWDLTFP

SEQ ID NO: 945 - protein, 86 aa, Chilobrachys jingzhao
MKVSVLITLAVLGVMFVWTSAAELEERGSDQRDSPAWLKSMERIFQSEERECRKMFGGCSVDSDCCAHLGCKPTLKYCAWDGTFGK

SEQ ID NO: 946 - protein, 86 aa, Chilobrachys jingzhao
MKASVLITLAVLGVMFVWASAAELEERGSDQRDSPAWLKSMERIFQSEERECRKMFGGCSVDSDCCAHLGCKPTLKYCAWDGTFGK

SEQ ID NO: 947 - protein, 86 aa, Chilobrachys jingzhao
MKVSVVITLAVLGVMFVWASAAELEERGSDQRDSPAWLKSMERIFQSEERECRKMFGGCSVDSDCCAHLGCKPTLKYCAWDGTFGK

SEQ ID NO: 948 - protein, 86 aa, Chilobrachys jingzhao
MKVSVLITLAVLGVMFVWASAAELEERGSDQRDSPAWLKSMERIFRSEERECRKMFGGCSVDSDCCAHLGCKPTLKYCAWDGTFGK

SEQ ID NO: 949 - protein, 86 aa, Chilobrachys jingzhao
MKVSVLITLAVLGVMFVWASAAELEERGSDQRDSPAWLKSMERIFQSEERECRKMFGGCSVDSDCCAHLGCKPTLKYCAWDGTFGK

SEQ ID NO: 950 - protein, 83 aa, Chilobrachys jingzhao
MKGSAFAIILGLVVLCACSFAEDEQDQFASPNELLRSMFLESRHELIPEVEGRYCQKWMWTCDSERKCCEGYVCELWCKYNLG

SEQ ID NO: 951 - protein, 62 aa, Chilobrachys jingzhao; identical to SEQ ID NO: 734

SEQ ID NO: 952 - protein, 62 aa, Chilobrachys jingzhao
MKTSILFVIFSLALVFALSPATEIEETDRACGQFWWKCGEGKPPCCANFACKIGLYLCIWSP

SEQ ID NO: 953 - protein, 63 aa, Chilobrachys jingzhao
MKSTSILFILGLALLLVLAFEVQVGESDGECGGFWWKCGSGKPACCPKYVCSPKWGLCNFPMP

SEQ ID NO: 954 - protein, 77 aa, Chilobrachys jingzhao
MKTSVLLVILGIAAITVQCTASESVKQDSLRTFVDAVLGWNAEMASEARCGGWMAKCADSDDCCETFHCTRFNVCGK

SEQ ID NO: 955 - protein, 50 aa, Chilobrachys jingzhao
MYDEILSAFFEVNDELQSEARCGEKNDRCKTNQDCCSGFRCTKFRRCGRR

SEQ ID NO: 956 - protein, 35 aa, Grammostola rosea
GCLEFWWKCNPNDDKCCRPKLKCSKLFKLCNFSSG

SEQ ID NO: 957 - protein, 39 aa, Aphonopelma sp.
LFECVLSCDIKKNGKPCKPKGEKKCSGGWRCKINFCLKV

SEQ ID NO: 958 - protein, 78 aa, Atrax robustus; identical to SEQ ID NO: 598

SEQ ID NO: 959 - protein, 98 aa, Hadronyche versuta
MKFSKLSLTLALILTQAIFVLCGKINEDFMKNDLESQALHDEIRKPIDSENPDTERLLDCLLDNRVCSSDKDCCGMTPSCTMGLCVPSVGGLVGGILG

SEQ ID NO: 960 - protein, 98 aa, Atrax robustus; identical to SEQ ID NO: 535

SEQ ID NO: 961 - protein, 98 aa, Hadronyche versuta; identical to SEQ ID NO: 537

SEQ ID NO: 962 - protein, 98 aa, Hadronyche versuta; identical to SEQ ID NO: 538

SEQ ID NO: 963 - protein, 98 aa, Hadronyche versuta; identical to SEQ ID NO: 539

SEQ ID NO: 964 - protein, 98 aa, Hadronyche versuta; identical to SEQ ID NO: 540

SEQ ID NO: 965 - protein, 93 aa, Hadronyche versuta; identical to SEQ ID NO: 541

SEQ ID NO: 966 - protein, 98 aa, Hadronyche versuta; identical to SEQ ID NO: 543

SEQ ID NO: 967 - protein, 98 aa, Atrax robustus; identical to SEQ ID NO: 542

SEQ ID NO: 968 - protein, 98 aa, Hadronyche versuta; identical to SEQ ID NO: 544

SEQ ID NO: 969 - protein, 98 aa, Hadronyche versuta; identical to SEQ ID NO: 549

SEQ ID NO: 970 - protein, 96 aa, Atrax robustus; identical to SEQ ID NO: 550

SEQ ID NO: 971 - protein, 98 aa, Hadronyche versuta; identical to SEQ ID NO: 547

SEQ ID NO: 972 - protein, 98 aa, Hadronyche versuta; identical to SEQ ID NO: 548

SEQ ID NO: 973 - protein, 93 aa, Hadronyche versuta; identical to SEQ ID NO: 546

SEQ ID NO: 974 - protein, 97 aa, Hadronyche versuta; identical to SEQ ID NO: 545

SEQ ID NO: 975 - protein, 96 aa, Atrax robustus; identical to SEQ ID NO: 551

SEQ ID NO: 976 - protein, 101 aa, Hadronyche versuta; identical to SEQ ID NO: 552

SEQ ID NO: 977 - protein, 101 aa, Hadronyche versuta; identical to SEQ ID NO: 553

SEQ ID NO: 978 - protein, 101 aa, Hadronyche versuta; identical to SEQ ID NO: 554

SEQ ID NO: 979 - protein, 101 aa, Hadronyche versuta; identical to SEQ ID NO: 557

SEQ ID NO: 980 - protein, 101 aa, Hadronyche versuta; identical to SEQ ID NO: 558

SEQ ID NO: 981 - protein, 100 aa, Hadronyche infensa
MKFSKLSLTLALILTQALFVLCGKINEDFMEHGLESHALHDEIRKPITEKADAERLVDCVVNTLGCSSDKDCCGMTPSCTLGICAPSVGGLVGGLLGRAL

SEQ ID NO: 982 - protein, 101 aa, Hadronyche infensa; identical to SEQ ID NO: 556

SEQ ID NO: 983 - protein, 100 aa, Hadronyche versuta; identical to SEQ ID NO: 559

SEQ ID NO: 984 - protein, 97 aa, Atrax robustus; identical to SEQ ID NO: 560

SEQ ID NO: 985 - protein, 97 aa, Atrax robustus; identical to SEQ ID NO: 561

SEQ ID NO: 986 - protein, 101 aa, Hadronyche versuta; identical to SEQ ID NO: 562

SEQ ID NO: 987 - protein, 101 aa, Hadronyche versuta; identical to SEQ ID NO: 563

SEQ ID NO: 988 - protein, 101 aa, Hadronyche versuta; identical to SEQ ID NO: 564

SEQ ID NO: 989 - protein, 101 aa, Hadronyche versuta; identical to SEQ ID NO: 565

SEQ ID NO: 990 - protein, 101 aa, Hadronyche versuta; identical to SEQ ID NO: 566

SEQ ID NO: 991 - protein, 101 aa, Hadronyche versuta; identical to SEQ ID NO: 567

SEQ ID NO: 992 - protein, 95 aa, Hadronyche versuta; identical to SEQ ID NO: 568

SEQ ID NO: 993 - protein, 29 aa, Eucratoscelus constrictus
YCQKFLWTCDTERKCCEDMVCELWCKYKE

SEQ ID NO: 994 - protein, 29 aa, Eucratoscelus constrictus
YCQFKMWTCDSERKCCEDMVCRLWCKLNL

SEQ ID NO: 995 - protein, 63 aa, Agelena orientalis
LLLISAMVGSMIAAVPEEESLQLSEDERGGCLPHNRFCNALSGPRCCSGLTCKELNIWASKCL

SEQ ID NO: 996 - protein, 27 aa, Conus amadis
  MISC_FEATURE (27)..(27): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKQAGESCDIFSQNCCVGTCAFICIEX

SEQ ID NO: 997 - protein, 28 aa, Conus catus
  MISC_FEATURE (28)..(28): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKSKGAKCSKLMYDCCSGSCSGTVGRCX

SEQ ID NO: 998 - protein, 33 aa, Conus ermineus
  MISC_FEATURE (6)..(6): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (33)..(33): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
DDCIKXYGFCSLPILKNGLCCSGACVGVCADLX

SEQ ID NO: 999 - protein, 33 aa, Conus ermineus; identical to SEQ ID NO: 998
  MISC_FEATURE (6)..(6): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (33)..(33): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.

SEQ ID NO: 1000 - protein, 34 aa, Conus geographus
ACSGRGSRCPPQCCMGLRCGRGNPQKCIGAHEDV

SEQ ID NO: 1001 - protein, 23 aa, Conus geographus
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
RDCCTPPRKCKDRRCKPMKCCAX

SEQ ID NO: 1002 - protein, 28 aa, Conus geographus
  MISC_FEATURE (28)..(28): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKSPGSSCSPTSYNCCRSCNPYTKRCYX

SEQ ID NO: 1003 - protein, 23 aa, Conus geographus
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
RDCCTPPKKCKDRQCKPQRCCAX

SEQ ID NO: 1004 - protein, 23 aa, Conus geographus
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
RDCCTPPKKCKDRQCKPQRCCAX

SEQ ID NO: 1005 - protein, 28 aa, Conus geographus
  MISC_FEATURE (28)..(28): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKSPGSSCSPTSYNCCRSCNPYTKRCYX

SEQ ID NO: 1006 - protein, 28 aa, Conus geographus
  MISC_FEATURE (28)..(28): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKSPGSSCSPTSYNCCRSCNPYTKRCYX

SEQ ID NO: 1007 - protein, 23 aa, Conus geographus
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
RDCCTPPKKCKDRQCKPQRCCAX

SEQ ID NO: 1008 - protein, 23 aa, Conus geographus
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
RDCCTPPKKCKDRQCKPQRCCAX

SEQ ID NO: 1009 - protein, 28 aa, Conus gloriamaris
  MISC_FEATURE (28)..(28): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
SCNNSCQSHSDCASHCICTFRGCGAVNX

SEQ ID NO: 1010 - protein, 17 aa, Conus kinoshitai
  MISC_FEATURE (17)..(17): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CCNCSSKWCRDHSRCCX

SEQ ID NO: 1011 - protein, 26 aa, Conus magus
  MISC_FEATURE (26)..(26): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKGKGAKCSRLMYDCCTGSCRSGKCX

SEQ ID NO: 1012 - protein, 26 aa, Conus magus
  MISC_FEATURE (26)..(26): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKGKGAKCSRLMYDCCTGSCRSGKCX

SEQ ID NO: 1013 - protein, 26 aa, Conus magus
  MISC_FEATURE (26)..(26): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKGKGAKCSRLMYDCCTGSCRSGKCX

SEQ ID NO: 1014 - protein, 26 aa, Conus magus
  MISC_FEATURE (26)..(26): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKGKGAKCSRLMYDCCTGSCRSGKCX

SEQ ID NO: 1015 - protein, 26 aa, Conus magus
  MISC_FEATURE (26)..(26): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKGKGAKCSRLMYDCCTGSCRSGKCX

SEQ ID NO: 1016 - protein, 31 aa, Conus marmoreus
ACSKKWEYCIVPILGFVYCCPGLICGPFVCV

SEQ ID NO: 1017 - protein, 15 aa, Conus marmoreus
DWEYHAHPKPNSFWT

SEQ ID NO: 1018 - protein, 16 aa, Conus marmoreus
CCAPSACRLGCRPCCR

SEQ ID NO: 1019 - protein, 16 aa, Conus marmoreus
CCAPSACRLGCRPCCR

SEQ ID NO: 1020 - protein, 28 aa, Conus purpurascens
  MISC_FEATURE (28)..(28): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CRIPNQKCFQHLDDCCSRKCNRFNKCVX

SEQ ID NO: 1021 - protein, 25 aa, Conus purpurascens
  MISC_FEATURE (25)..(25): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
HPPCCLYGKCRRYPGCSSASCCQRX

SEQ ID NO: 1022 - protein, 28 aa, Conus purpurascens
  MISC_FEATURE (28)..(28): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CRIPNQKCFQHLDDCCSRKCNRFNKCVX

SEQ ID NO: 1023 - protein, 25 aa, Conus purpurascens
  MISC_FEATURE (25)..(25): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
HPPCCLYGKCRRYPGCSSASCCQRX

SEQ ID NO: 1024 - protein, 25 aa, Conus purpurascens
  MISC_FEATURE (25)..(25): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
GPPCCLYGSCRPFPGCYNALCCRKX

SEQ ID NO: 1025 - protein, 23 aa, Conus purpurascens
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
QRLCCGFPKSCRSRQCKPHRCCX

SEQ ID NO: 1026 - protein, 22 aa, Conus stercusmuscarum
QRCCNGRRGCSSRWCRDHSRCC

SEQ ID NO: 1027 - protein, 26 aa, Conus striatus
  MISC_FEATURE (26)..(26): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKAAGKPCSRIAYNCCTGSCRSGKCX

SEQ ID NO: 1028 - protein, 27 aa, Conus striatus
  MISC_FEATURE (27)..(27): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
CKLKGQSCRKTSYDCCSGSCGRSGKCX

SEQ ID NO: 1029 - protein, 21 aa, Conus striatus
  MISC_FEATURE (21)..(21): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
QNCCNGGCSSKWCRDHARCCX

SEQ ID NO: 1030 - protein, 26 aa, Conus textile
CKQADEPCDVFSLDCCTGICLGVCMW

SEQ ID NO: 1031 - protein, 27 aa, Conus textile
WCKQSGEMCNLLDQNCCDGYCIVLVCT

SEQ ID NO: 1032 - protein, 30 aa, Conus tulipa
SCSGRDSRCPPVCCMGLMCSRGKCVSIYGE

SEQ ID NO: 1033 - protein, 23 aa, Conus tulipa
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
RHGCCKGPKGCSSRECRPQHCCX

SEQ ID NO: 1034 - protein, 21 aa, Striated cone
  MISC_FEATURE (21)..(21): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
QNCCNGGCSSKWCRDHARCCX

SEQ ID NO: 1035 - protein, 24 aa, Hordeum vulgare
MANKHLSLSLFLVLLGLSASLASG

SEQ ID NO: 1036 - protein, 238 aa, Aequorea victoria; identical to SEQ ID NO: 7

SEQ ID NO: 1037 - protein, 4 aa, Pisum sativum
IGER

SEQ ID NO: 1038 - protein, 305 aa, Hadronyche versuta; identical to SEQ ID NO: 11

SEQ ID NO: 1039 - protein, 282 aa, Hadronyche versuta; identical to SEQ ID NO: 10

SEQ ID NO: 1040 - protein, 61 aa, Hadronyche versuta; identical to SEQ ID NO: 9

SEQ ID NO: 1041 - protein, 38 aa, Hadronyche versuta; identical to SEQ ID NO: 8

SEQ ID NO: 1042 - protein, 41 aa, Hadronyche versuta; identical to SEQ ID NO: 5

SEQ ID NO: 1043 - protein, 32 aa, Phoneutria nigriventer; identical to SEQ ID NO: 774

SEQ ID NO: 1044 - protein, 31 aa, Phoneutria nigriventer; identical to SEQ ID NO: 787

SEQ ID NO: 1045 - protein, 33 aa, Phoneutria nigriventer; identical to SEQ ID NO: 760

SEQ ID NO: 1046 - protein, 35 aa, Allagelena opulenta; identical to SEQ ID NO: 805

SEQ ID NO: 1047 - protein, 68 aa, Cupiennius salei
KDDKNCIPKHHECTNDKKNCCKKGLTKMKCKCFTVADAKGATSERCACDSSLLQKFGFTGLHIIKGLF

SEQ ID NO: 1048 - protein, 80 aa, Calisoga sp.
MKYFVVFCVLIIAVAAFTSAAEDGEVFEENPLEFPKTIQKRCISARYPCSNSKDCCSGNCGTFWTCYIRKDPCSKECLAP

SEQ ID NO: 1049 - protein, 39 aa, Calisoga sp.
CISARYPCSNSKDCCSGNCGTFWTCFIRKDPCSKECLAP

SEQ ID NO: 1050 - protein, 39 aa, Calisoga sp.
CISARYPCSNSKDCCSGSCGIFWTCYLRKDPCSKECLAP

SEQ ID NO: 1051 - protein, 82 aa, Plectreurys tristis
MKHLIFSSALVCALVVCTFAEEQVNVPFLPDERAVKCIGWQETCNGNLPCCNECVMCECNIMGQNCRCNHPKATNECESRRR

SEQ ID NO: 1052 - protein, 61 aa, Plectreurys tristis
EEQVNVPFLPDERAVKCIGWQETCNGQLPCCDGCVMCECNIMGQNCRCNHPKMTSECGSRR

SEQ ID NO: 1053 - protein, 79 aa, Plectreurys tristis
HLILASALICALVVCTFAEEQVNVPFLPDEREVKCIGWQEYCRGNLPCCDDCVMCECNIMGQNCRCNHPRITSECGSRR

SEQ ID NO: 1054 - protein, 45 aa, Plectreurys tristis
AVKCIGWQETCNGNLPCCNECVMCECNIMGQNCRCNHPKATNECE

SEQ ID NO: 1055 - protein, 46 aa, Plectreurys tristis
AVKCIGWQETCNGKLPCCDGCVMCECNIMGQNCRCNHPKATSECES

SEQ ID NO: 1056 - protein, 31 aa, Coremiocnemis valida; identical to SEQ ID NO: 857

SEQ ID NO: 1057 - protein, 85 aa, Haplopelma huwenum; identical to SEQ ID NO: 817

SEQ ID NO: 1058 - protein, 84 aa, Haplopelma huwenum; identical to SEQ ID NO: 904

SEQ ID NO: 1059 - protein, 85 aa, Haplopelma huwenum; identical to SEQ ID NO: 905

SEQ ID NO: 1060 - protein, 37 aa, Haplopelma huwenum; identical to SEQ ID NO: 818

SEQ ID NO: 1061 - protein, 85 aa, Haplopelma huwenum; identical to SEQ ID NO: 862

SEQ ID NO: 1062 - protein, 84 aa, Haplopelma huwenum; identical to SEQ ID NO: 906

SEQ ID NO: 1063 - protein, 85 aa, Haplopelma huwenum; identical to SEQ ID NO: 911

SEQ ID NO: 1064 - protein, 85 aa, Haplopelma huwenum; identical to SEQ ID NO: 872

SEQ ID NO: 1065 - protein, 83 aa, Haplopelma huwenum; identical to SEQ ID NO: 823

SEQ ID NO: 1066 - protein, 84 aa, Haplopelma huwenum; identical to SEQ ID NO: 907

SEQ ID NO: 1067 - protein, 84 aa, Haplopelma huwenum; identical to SEQ ID NO: 908

SEQ ID NO: 1068 - protein, 83 aa, Haplopelma huwenum; identical to SEQ ID NO: 823

SEQ ID NO: 1069 - protein, 84 aa, Haplopelma huwenum; identical to SEQ ID NO: 870

SEQ ID NO: 1070 - protein, 70 aa, Agelena orientalis; identical to SEQ ID NO: 806

SEQ ID NO: 1071 - protein, 35 aa, Allagelena opulenta; identical to SEQ ID NO: 805

SEQ ID NO: 1072 - protein, 63 aa, Cupiennius salei
SDCTLRNHDCTDDRHSCCRSKMFKDVCTCFYPSQAKKELCTCQQPKHLKYIEKGLQKAKDYAT

SEQ ID NO: 1073 - protein, 88 aa, Cupiennius salei
MKVAILILSILVLAVASETIEEYRDDFAVEELERATCAGQDKPCKETCDCCGERGECVCALSYEGKYRCICRQGNFLIAWHKLASCKK

SEQ ID NO: 1074 - protein, 37 aa, Phoneutria nigriventer
CNSKGTPCTNADECCGGKCAYNVWNCIGGGCSKTCGY

SEQ ID NO: 1075 - protein, 46 aa, Apomastus schlingeri
KECMTDGTVCYIHNHNDCCGSCLCSNGPIARPWEMMVGNCMCGPKA

SEQ ID NO: 1076 - protein, 46 aa, Segestria florentina
KECMADETVCYIHNHNNCCGSCLCLNGPYARPWEMLVGNCKCGPKE

SEQ ID NO: 1077 - protein, 46 aa, Segestria florentina
KECMVDGTVCYIHNHNDCCGSCLCLNGPIARPWEMMVGNCKCGPKA

SEQ ID NO: 1078 - protein, 46 aa, Segestria florentina
KECMVDGTVCYIHNHNDCCGSCLCLNGPIARPWKMMVGNCKCGPKA

SEQ ID NO: 1079 - protein, 46 aa, Segestria florentina
KECMVDGTVCYIHNHNDCCGSCLCPNGPLARPWEMLVGNCKCGPKA

SEQ ID NO: 1080 - protein, 46 aa, Segestria florentina
KECMTDETVCYIHNHNDCCGSCLCLNGPIARPWEMMVGNCKCGPKA

SEQ ID NO: 1081 - protein, 46 aa, Segestria florentina
KECMADGTVCYIHNHNDCCGSCLCPNGPLARPWEVLVGNCKCGPKA

SEQ ID NO: 1082 - protein, 92 aa, Segestria florentina
KECMADGTVCYIHNHNDCCGSCLCPNGPLARPWEMLVGNCKCGPKAKECMADGTVCYIHNHNDCCGSCLCPNGPLARPWEMLVGNCKCGPKA

SEQ ID NO: 1083 - protein, 87 aa, Haplopelma huwenum; identical to SEQ ID NO: 819

SEQ ID NO: 1084 - protein, 32 aa, Apomastus schlingeri; identical to SEQ ID NO: 851

SEQ ID NO: 1085 - protein, 49 aa, Plectreurys tristis
GCKGFLVKCDSNSECCKTAIVKGKKKQLSCLCGAWGAGCSCSFRCGNRC

SEQ ID NO: 1086 - protein, 32 aa, Phoneutria nigriventer; identical to SEQ ID NO: 790

SEQ ID NO: 1087 - protein, 54 aa, Phoneutria keyserlingi
ATCAGQDKPCKETCDCCGERGECVCGLSYEGKYRCICRQGTFLIAWYKLASCKK

SEQ ID NO: 1088 - protein, 79 aa, Macrothele gigas; identical to SEQ ID NO: 840

SEQ ID NO: 1089 - protein, 29 aa, Macrothele raveni
GCKLTFWKCKNKKECCGWNACALGICMPR

SEQ ID NO: 1090 - protein, 81 aa, Phoneutria nigriventer
MKVAIVFLSLLVLAFASESIEENREEFPVEESARCADINGACKSDCDCCGDSVTCDCYWSDSCKCRESNFKIGMAIRKKFC

SEQ ID NO: 1091 - protein, 42 aa, Missulena bradleyi
CAKKREWCAKTEDCCCPMKCIYAWYNEQSSCQTTFSGMFKKC

SEQ ID NO: 1092 - protein, 37 aa, Pireneitega luctuosa
GCLGEGEKCADWSGPSCCDGFYCSCRSMPYCRCRNNS

SEQ ID NO: 1093 - protein, 37 aa, Pireneitega luctuosa
ACVGDGQRCASWSGPYCCDGYYCSCRSMPYCRCRNNS

SEQ ID NO: 1094 - protein, 36 aa, Pirenitega luctuosa
ADCLNEGDWCADWSGPSCCGEMWCSCPGFGKCRCKK

SEQ ID NO: 1095 - protein, 37 aa, Pireneitega luctuosa
ACATKNQRCASWAGPYCCDGFYCSCRSYPGCMCRPNS

SEQ ID NO: 1096 - protein, 47 aa, Ancylometes sp.
ATCAGQDKPCKVNCDCCGERGECVCGGPCICRQGNVFIAWSKLMTCK

SEQ ID NO: 1097 - protein, 48 aa, Phoneutria nigriventer
CGDINAACKEDCDCCGYTTACDCYWSKSCKCREAAIVIYTAPKKKLTC

SEQ ID NO: 1098 - protein, 82 aa, Phoneutria nigriventer
MKVAIVFLSLLVLAFASESIEENREEFPVEESARCGDINAACKEDCDCCGYTTACDCYWSKSCKCREAAIVIYTAPKKKLTC

SEQ ID NO: 1099 - protein, 48 aa, Phoneutria nigriventer
CGDINAACKEDCDCCGYTTACDCYWSSSCKCREAAIVIYTAPKKKLTC

SEQ ID NO: 1100 - protein, 82 aa, Phoneutria nigriventer
MKVAILFLSILVLAVASESIEESRDDFAVEELGRATCAGQDQPCKETCDCCGERGECVCGGPCICRQGYFWIAWYKLANCKK

SEQ ID NO: 1101 - protein, 49 aa, Phoneutria nigriventer
ATCAGQDQTCKVTCDCCGERGECVCGGPCICRQGNFLIAAYKLASCKCK

SEQ ID NO: 1102 - protein, 82 aa, Phoneutria nigriventer
MKVAILFLSILVLAVASESIEESRDDFAVEELGRATCAGQDQTCKVTCDCCGERGECVCGGPCICRQGNFLIAWYKLASCKK

SEQ ID NO: 1103 - protein, 47 aa, Phoneutria reidyi
GTCAGQDKPCKETCDCCGERGQCVCEGPCICRQGYFWIAAYKLGNCK

SEQ ID NO: 1104 - protein, 42 aa, Atrax robustus
CAKKRNWCGKNEDCCCPMKCIYAWYNQQGSCQTTITGLFKKC

SEQ ID NO: 1105 - protein, 42 aa, Hadronyche versuta
CAKKRNWCGKTEDCCCPMKCVYAWYNEQGSCQSTISALWKKC

SEQ ID NO: 1106 - protein, 42 aa, Hadronyche versuta
CSRSDGWCGKTEDCCCPMKCIKAWYKQNGNCQNTISAIWKNC

SEQ ID NO: 1107 - protein, 42 aa, Illawara wisharti
CAKKRNWCGKNEDCCCPMKCIYAWYNQQGSCQSTITGLFKKC

SEQ ID NO: 1108 - protein, 105 aa, Macrothele gigas
MKTLVIACVALVLVVVHGEVIEEVNEKQLQESVEEKYSLLQRLEKLDEAITAEENRNSRVRRCGSKRAWCKEKKDCCCGYNCVYAWYNQQSSCERKWKYLFTGEC

SEQ ID NO: 1109 - protein, 70 aa, Macrothele gigas
MKILEKALLENDSAAEEESRNLRTKRCARKRAWCEKTENCCCPMKCIYAWYNGQSSCDHTISTIWTSCPK

SEQ ID NO: 1110 - protein, 37 aa, Hadronyche formidabilis; identical to SEQ ID NO: 629

SEQ ID NO: 1111 - protein, 36 aa, Hadronyche versuta
TICTGADRPCAACCPCCPGTSCQGPESNGVVYCRNF

SEQ ID NO: 1112 - protein, 36 aa, Hadronyche versuta
TICTGADRPCAACCPCCPGTSCQGPEPNGVSYCRND

SEQ ID NO: 1113 - protein, 37 aa, Hadronyche versuta
AICTGADRPCAACCPCCPGTSCKAESNGVSYCRKDEP

SEQ ID NO: 1114 - protein, 74 aa, Hadronyche versuta
MNTATCFIVLLDVATVIGGIEAGESDMRKDVMGLFRRAICTGADRPCAACCPCCPGTSCKAESNGVSYCRKDEP

SEQ ID NO: 1115 - protein, 74 aa, Hadronyche versuta
MNTATCFIVLLVVATVIGGIEAGEFDMRKDVMGLFRRAICTGADRPCAACCPCCPGTSCKAESNGVSYCRKDEP

SEQ ID NO: 1116 - protein, 74 aa, Hadronyche versuta
MNTATCFIVFLVVATVIGGIEAGESDMRKDVMGLFRRAICTGADRPCAACCPCCPGTSCKAESNGVSYCRKDEP

SEQ ID NO: 1117 - protein, 74 aa, Hadronyche versuta
MNTATCFIVLLVVATVIGGIEAGESDMRKDVMGLFRRVICTGADSPCAACCPCCPGTSCKAESNGVSYCRKDEP

SEQ ID NO: 1118 - protein, 74 aa, Hadronyche versuta
MNTATCFIVLLVVATVIGGIEAGEFDMRKDVMGLFRRAICPGADRPCAACCPCCPGTSCKAESNGVFYCRKDEP

SEQ ID NO: 1119 - protein, 29 aa, Eucratoscelus constrictus
YCQKFLWTCDTERKCCEDMVCELWCKLEK

SEQ ID NO: 1120 - protein, 29 aa, Eucratoscelus constrictus
YCQKFLWTCDTERKCCEDMVCELWCKYKE

SEQ ID NO: 1121 - protein, 36 aa, Agelenopsis aperta
ECVPENGHCRDWYDECCEGFYCSCRQPPKCICRNNN

SEQ ID NO: 1122 - protein, 37 aa, Agelenopsis aperta; identical to SEQ ID NO: 637

SEQ ID NO: 1123 - protein, 38 aa, Agelenopsis aperta; identical to SEQ ID NO: 638

SEQ ID NO: 1124 - protein, 37 aa, Agelenopsis aperta; identical to SEQ ID NO: 639

SEQ ID NO: 1125 - protein, 37 aa, Agelenopsis aperta; identical to SEQ ID NO: 640

SEQ ID NO: 1126 - protein, 37 aa, Hololena curta; identical to SEQ ID NO: 641

SEQ ID NO: 1127 - protein, 36 aa, Hololena curta; identical to SEQ ID NO: 642

SEQ ID NO: 1128 - protein, 38 aa, Hololena curta; identical to SEQ ID NO: 638

SEQ ID NO: 1129 - protein, 38 aa, Hololena curta; identical to SEQ ID NO: 643

SEQ ID NO: 1130 - protein, 94 aa, Diguetia canities
MKVFVVLLCLSLAAVYALEERLDKDADIMLDSPADMERAKDGDVEGPAGCKKYDVECDSGECCQKQYLWYKWRPLDCRCLKSGFFSSKCVCRDV

SEQ ID NO: 1131 - protein, 58 aa, Diguetia canities
AKDGDVKGPAGCMKYKSGDCRGKTCCDQQYLWYKWRNLACRCFTVEVFKKDCWCNDIS

SEQ ID NO: 1132 - protein, 121 aa, Macrothele gigas; identical to SEQ ID NO: 839

SEQ ID NO: 1133 - protein, 38 aa, Macrothele gigas; identical to SEQ ID NO: 838

SEQ ID NO: 1134 - protein, 99 aa, Macrothele gigas; identical to SEQ ID NO: 854

SEQ ID NO: 1135 - protein, 46 aa, Macrothele gigas
GGCIKWNHSCQTTTLKCCGKCVVCYCHTPWGTNCRCDRTRLFCTED

SEQ ID NO: 1136 - protein, 87 aa, Haplopelma huwenum; identical to SEQ ID NO: 819

SEQ ID NO: 1137 - protein, 39 aa, Missulena bradleyi; identical to SEQ ID NO: 762

SEQ ID NO: 1138 - protein, 48 aa, Agelenopsis aperta
KKKCIAKDYGRCKWGGTPCCRGRGCICSIMGTNCECKPRLIMEGLGLA

SEQ ID NO: 1139 - protein, 83 aa, Agelenopsis aperta
MKLCMTLLITAIAVVTFVVATQEESAEFNEVEESREDNCIAEDYGKCTWGGTKCCRGRPCRCSMIGTNCECTPRLIMEGLSFA

SEQ ID NO: 1140 - protein, 83 aa, Agelenopsis aperta; identical to SEQ ID NO: 1139

SEQ ID NO: 1141 - protein, 85 aa, Atrax robustus; identical to SEQ ID NO: 724

SEQ ID NO: 1142 - protein, 37 aa, Atrax robustus; identical to SEQ ID NO: 627

SEQ ID NO: 1143 - protein, 73 aa, Atrax robustus; identical to SEQ ID NO: 602

SEQ ID NO: 1144 - protein, 78 aa, Atrax robustus; identical to SEQ ID NO: 592

SEQ ID NO: 1145 - protein, 78 aa, Atrax robustus; identical to SEQ ID NO: 594

SEQ ID NO: 1146 - protein, 78 aa, Atrax robustus; identical to SEQ ID NO: 600

SEQ ID NO: 1147 - protein, 78 aa, Atrax robustus; identical to SEQ ID NO: 596

SEQ ID NO: 1148 - protein, 76 aa, Atrax robustus; identical to SEQ ID NO: 582

SEQ ID NO: 1149 - protein, 78 aa, Atrax robustus; identical to SEQ ID NO: 598

SEQ ID NO: 1150 - protein, 98 aa, Atrax robustus; identical to SEQ ID NO: 535

SEQ ID NO: 1151 - protein, 98 aa, Atrax robustus; identical to SEQ ID NO: 542

SEQ ID NO: 1152 - protein, 96 aa, Atrax robustus; identical to SEQ ID NO: 550

SEQ ID NO: 1153 - protein, 96 aa, Atrax robustus; identical to SEQ ID NO: 551

SEQ ID NO: 1154 - protein, 97 aa, Atrax robustus; identical to SEQ ID NO: 560

SEQ ID NO: 1155 - protein, 97 aa, Atrax robustus; identical to SEQ ID NO: 561

SEQ ID NO: 1156 - protein, 100 aa, Atrax sp. Illawarra
MKFSKLSITLAVILTQAVFVLCGMKNEDFMEKGLESNELHDAIKKPVNSGKPDTERLLDCVLSRVCSPDANCCGLTPICKMGLCVPKVGGLLGGLLGGIL

SEQ ID NO: 1157 - protein, 100 aa, Atrax sp. Illawarra
MKFSKLSITLAVILTQAVFVLCGMKNEDFMEKGLESNELHDAIKKPVNSGKPDTERLLDCVLSRVCSSDANCCGLTPTCKMGLCVPKVGGLLGGLLGGIL

SEQ ID NO: 1158 - protein, 37 aa, Hadronyche formidabilis; identical to SEQ ID NO: 631

SEQ ID NO: 1159 - protein, 36 aa, Hadronyche infensa; identical to SEQ ID NO: 615

SEQ ID NO: 1160 - protein, 78 aa, Hadronyche infensa; identical to SEQ ID NO: 620

SEQ ID NO: 1161 - protein, 78 aa, Hadronyche infensa; identical to SEQ ID NO: 614

SEQ ID NO: 1162 - protein, 37 aa, Hadronyche infensa; identical to SEQ ID NO: 609

SEQ ID NO: 1163 - protein, 79 aa, Hadronyche infensa; identical to SEQ ID NO: 918

SEQ ID NO: 1164 - protein, 79 aa, Hadronyche infensa; identical to SEQ ID NO: 608

SEQ ID NO: 1165 - protein, 79 aa, Hadronyche infensa; identical to SEQ ID NO: 610

SEQ ID NO: 1166 - protein, 79 aa, Hadronyche infensa; identical to SEQ ID NO: 917

SEQ ID NO: 1167 - protein, 37 aa, Hadronyche infensa; identical to SEQ ID NO: 613

SEQ ID NO: 1168 - protein, 78 aa, Hadronyche infensa; identical to SEQ ID NO: 612

SEQ ID NO: 1169 - protein, 37 aa, Hadronyche versuta
SPTCIPSGGPCPYNENCCSQSCTFKENENGNTVKRCD

SEQ ID NO: 1170 - protein, 37 aa, Hadronyche versuta; identical to SEQ ID NO: 767

SEQ ID NO: 1171 - protein, 37 aa, Hadronyche versuta; identical to SEQ ID NO: 769

SEQ ID NO: 1172 - protein, 37 aa, Hadronyche versuta; identical to SEQ ID NO: 601

SEQ ID NO: 1173 - protein, 37 aa, Hadronyche versuta; identical to SEQ ID NO: 771

SEQ ID NO: 1174 - protein, 37 aa, Hadronyche versuta; identical to SEQ ID NO: 772

SEQ ID NO: 1175 - protein, 76 aa, Hadronyche versuta; identical to SEQ ID NO: 582

SEQ ID NO: 1176 - protein, 76 aa, Hadronyche versuta; identical to SEQ ID NO: 580

SEQ ID NO: 1177 - protein, 76 aa, Hadronyche versuta; identical to SEQ ID NO: 584

SEQ ID NO: 1178 - protein, 45 aa, Hadronyche versuta; identical to SEQ ID NO: 589

SEQ ID NO: 1179 - protein, 98 aa, Hadronyche versuta; identical to SEQ ID NO: 959

SEQ ID NO: 1180 - protein, 98 aa, Hadronyche versuta; identical to SEQ ID NO: 537

SEQ ID NO: 1181 - protein, 98 aa, Hadronyche versuta; identical to SEQ ID NO: 538

SEQ ID NO: 1182 - protein, 98 aa, Hadronyche versuta; identical to SEQ ID NO: 539

SEQ ID NO: 1183 - protein, 98 aa, Hadronyche versuta; identical to SEQ ID NO: 540

SEQ ID NO: 1184 - protein, 93 aa, Hadronyche versuta; identical to SEQ ID NO: 541

SEQ ID NO: 1185 - protein, 98 aa, Hadronyche versuta; identical to SEQ ID NO: 543

SEQ ID NO: 1186 - protein, 98 aa, Hadronyche versuta; identical to SEQ ID NO: 544

SEQ ID NO: 1187 - protein, 98 aa, Hadronyche versuta; identical to SEQ ID NO: 548

SEQ ID NO: 1188 - protein, 93 aa, Hadronyche versuta; identical to SEQ ID NO: 546

SEQ ID NO: 1189 - protein, 97 aa, Hadronyche versuta; identical to SEQ ID NO: 545

SEQ ID NO: 1190 - protein, 98 aa, Hadronyche versuta; identical to SEQ ID NO: 549

SEQ ID NO: 1191 - protein, 98 aa, Hadronyche versuta; identical to SEQ ID NO: 547

SEQ ID NO: 1192 - protein, 101 aa, Hadronyche versuta; identical to SEQ ID NO: 552

SEQ ID NO: 1193 - protein, 101 aa, Hadronyche versuta; identical to SEQ ID NO: 553

SEQ ID NO: 1194 - protein, 101 aa, Hadronyche versuta; identical to SEQ ID NO: 557

SEQ ID NO: 1195 - protein, 101 aa, Hadronyche versuta; identical to SEQ ID NO: 554

SEQ ID NO: 1196 - protein, 101 aa, Hadronyche versuta; identical to SEQ ID NO: 558

SEQ ID NO: 1197 - protein, 95 aa, Hadronyche versuta; identical to SEQ ID NO: 568

SEQ ID NO: 1198 - protein, 100 aa, Hadronyche versuta; identical to SEQ ID NO: 559

SEQ ID NO: 1199 - protein, 101 aa, Hadronyche versuta; identical to SEQ ID NO: 562

SEQ ID NO: 1200 - protein, 101 aa, Hadronyche versuta; identical to SEQ ID NO: 563

SEQ ID NO: 1201 - protein, 101 aa, Hadronyche versuta; identical to SEQ ID NO: 566

SEQ ID NO: 1202 - protein, 101 aa, Hadronyche versuta; identical to SEQ ID NO: 567

SEQ ID NO: 1203 - protein, 101 aa, Hadronyche versuta; identical to SEQ ID NO: 564

SEQ ID NO: 1204 - protein, 101 aa, Hadronyche versuta; identical to SEQ ID NO: 565

SEQ ID NO: 1205 - protein, 83 aa, Hadronyche venenata; identical to SEQ ID NO: 878

SEQ ID NO: 1206 - protein, 84 aa, Hadronyche venenata; identical to SEQ ID NO: 879

SEQ ID NO: 1207 - protein, 84 aa, Hadronyche venenata; identical to SEQ ID NO: 880

SEQ ID NO: 1208 - protein, 84 aa, Hadronyche venenata; identical to SEQ ID NO: 881

SEQ ID NO: 1209 - protein, 84 aa, Hadronyche venenata; identical to SEQ ID NO: 882

SEQ ID NO: 1210 - protein, 84 aa, Hadronyche venenata; identical to SEQ ID NO: 883

SEQ ID NO: 1211 - protein, 100 aa, Illawara wisharti; identical to SEQ ID NO: 1156

SEQ ID NO: 1212 - protein, 55 aa, Oxyopes lineatus
AWKCLPKDSTCGDDCDCCEGLHCHCPLRNMLPAILRCSCQSKDDHINTCPKYKKS

SEQ ID NO: 1213 - protein, 44 aa, Plectreurys tristis
ADCSATGDTCDHTKKCCDDCYTCRCGTPWGANCRCDYYKARCDT

SEQ ID NO: 1214 - protein, 39 aa, Aphonopelma sp.; identical to SEQ ID NO: 957

SEQ ID NO: 1215 - protein, 39 aa, Aphonopelma sp.; identical to SEQ ID NO: 777

SEQ ID NO: 1216 - protein, 39 aa, Aphonopelma sp.; identical to SEQ ID NO: 792

SEQ ID NO: 1217 - protein, 39 aa, Brachypelma albiceps; identical to SEQ ID NO: 844

SEQ ID NO: 1218 - protein, 39 aa, Brachypelma albiceps; identical to SEQ ID NO: 848

SEQ ID NO: 1219 - protein, 39 aa, Brachypelma smithi; identical to SEQ ID NO: 792

SEQ ID NO: 1220 - protein, 99 aa, Brachypelma smithi; identical to SEQ ID NO: 868

SEQ ID NO: 1221 - protein, 86 aa, Haplopelma huwenum; identical to SEQ ID NO: 821

SEQ ID NO: 1222 - protein, 47 aa, Anemonia erythraea
GAPCLCANSGPNTRGNDLNGIVWVFGCPSGWHDCHGRAMVGYCCQED

SEQ ID NO: 1223 - protein, 42 aa, Anthopleura elegantissima
GTTCYCGKTIGIYWFGTKTCPSNRGYTGSCGYFLGICCYPVD

SEQ ID NO: 1224 - protein, 42 aa, Anthopleura elegantissima
GTACSCGNSKGIYWFYRPSCPTDRGYTGSCRYFLGTCCTPAD

SEQ ID NO: 1225 - protein, 43 aa, Anemonia sulcata
AAPCFCSGKPGRGDLWILRGTCPGGYGYTSNCYKWPNICCYPH

SEQ ID NO: 1226 - protein, 43 aa, Anemonia sulcata
AAPCFCPGKPDRGDLWILRGTCPGGYGYTSNCYKWPNICCYPH

SEQ ID NO: 1227 - protein, 48 aa, Bunodosoma granulifera
GASCRCDSDGPTSRGNTLTGTLWLIGRCPSGWHNCRGSGPFIGYCCKQ

SEQ ID NO: 1228 - protein, 48 aa, Bunodosoma granulifera
GASCRCDSDGPTSRGDTLTGTLWLIGRCPSGWHNCRGSGPFIGYCCKQ

SEQ ID NO: 1229 - protein, 47 aa, Anthopleura elegantissima
GIACLCDSDGPSVRGNTLSGTYWLAGCPSGWHNCKSSGQLIGACCKQ

SEQ ID NO: 1230 - protein, 47 aa, Anthopleura elegantissima
GVPCLCDSDGPNVRGNTLSGTYWLAGCPSGWHNCKSSGPLIGACCKQ

SEQ ID NO: 1231 - protein, 47 aa, Anemonia sulcata
GVACLCDSDGPNVRGNTLSGTIWLAGCPSGWHNCKAHGPTIGWCCKQ

SEQ ID NO: 1232 - protein, 47 aa, Anthopleura fuscoviridis; identical to SEQ ID NO: 1231

SEQ ID NO: 1233 - protein, 48 aa, HETERACTIS CRISPA
ASCKCDDDGPDVRSATFTGTVDFAYCNAGWEKCLAVYTPVASCCRKKK

SEQ ID NO: 1234 - protein, 48 aa, Stoichactis helianthus
AACKCDDEGPDIRTAPLTGTVDLGSCNAGWEKCASYYTIIADCCRKKK

SEQ ID NO: 1235 - protein, 47 aa, Anthopleura elegantissima
GVPCLCDSDGPSVRGNTLSGILWLAGCPSGWHNCKAHGPTIGWCCKQ

SEQ ID NO: 1236 - protein, 47 aa, Anthopleura elegantissima
GVPCLCDSDGPNVRGNTLSGILWLAGCPSGWHNCKAHGPTIGWCCKQ

SEQ ID NO: 1237 - protein, 47 aa, Anemonia sulcata
GVPCLCDSDGPSVRGNTLSGIIWLAGCPSGWHNCKKHGPTIGWCCKQ

SEQ ID NO: 1238 - protein, 48 aa, Anthopleura fuscoviridis
GGVPCLCDSDGPSVRGNTLSGIIWLAGCPSGWHNCKAHGPTIGWCCKQ

SEQ ID NO: 1239 - protein, 48 aa, Heteractis crispa
GTCKCDDDGPDVRTATFTGSTEFANCNESWEKCLAVYTPVASCCRKKK

SEQ ID NO: 1240 - protein, 48 aa, Radianthus paumotensis
ASCKCDDDGPDVRSATFTGTVDFWNCNEGWEKCTAVYTPVASCCRKKK

SEQ ID NO: 1241 - protein, 31 aa, Parasicyonis actinostoloides
AGGKSTCCPCAMCKYTAGCPWGQCAHHCGCS

SEQ ID NO: 1242 - protein, 48 aa, Heteractis crispa
GNCKCDDEGPYVRTAPLTGYVDLGYCNEGWEKCASYYSPIAECCRKKK

SEQ ID NO: 1243 - protein, 48 aa, Radianthus paumotensis
GNCKCDDEGPNVRTAPLTGYVDLGYCNEGWEKCASYYSPIAECCRKKK

SEQ ID NO: 1244 - protein, 48 aa, Heteractis crispa
GNCKCDDEGPNVRTAPLTGYVDLGYCNEGWDKCASYYSPIAECCRKKK

SEQ ID NO: 1245 - protein, 46 aa, Anemonia sulcata
GVPCLCDSDGPSVRGNTLSGILWLAGCPSGWHNCKKHKPTIGWCCK

SEQ ID NO: 1246 - protein, 47 aa, Heteractis crispa
GNCKCDDEGPNVRTAPLTGYVDLGYCNEGWEKCASYYSPIAECCRKK

SEQ ID NO: 1247 - protein, 49 aa, Anthopleura xanthogrammica
GVSCLCDSDGPSVRGNTLSGTLWLYPSGCPSGWHNCKAHGPTIGWCCKQ

SEQ ID NO: 1248 - protein, 49 aa, Anthopleura xanthogrammica
GVPCLCDSDGPRPRGNTLSGILWFYPSGCPSGWHNCKAHGPNIGWCCKK

SEQ ID NO: 1249 - protein, 47 aa, Anthopleura elegantissima; identical to SEQ ID NO: 1235

SEQ ID NO: 1250 - protein, 36 aa, Actinia equina
GCKDNFSANTCKHVKANNNCGSQKYATNCAKTCGKC

SEQ ID NO: 1251 - protein, 37 aa, Bunodosoma granulifera
VCRDWFKETACRHAKSLGNCRTSQKYRANCAKTCELC

SEQ ID NO: 1252 - protein, 48 aa, Bunodosoma caissarum
GVACRCDSDGPTSRGNTLTGTLWLTGGCPSGWHNCRGSGPFIGYCCKK

SEQ ID NO: 1253 - protein, 41 aa, Bunodosoma caissarum
GLPCDCHGHTGTYWLNYYSKCPKGYGYTGRCRYLVGSCCYK

SEQ ID NO: 1254 - protein, 48 aa, Bunodosoma cangicum
GVACRCDSDGPTVRGNSLSGTLWLTGGCPSGWHNCRGSGPFIGYCCKK

SEQ ID NO: 1255 - protein, 35 aa, Stoichactis helianthus
RSCIDTIPKSRCTAFQCKHSMKYRLSFCRKTCGTC

SEQ ID NO: 1256 - protein, 47 aa, Anthopleura xanthogrammica
GVPCLCDSDGPNVRGNTLSGTYWLAGCPSGWHNCKSSGPNIGWCCKK

SEQ ID NO: 1257 - protein, 47 aa, Anthopleura xanthogrammica
GVACLCDADGPSVSGNTLSGILWLAGCPSGWHNCKAHGPTIGWCCKK

SEQ ID NO: 1258 - protein, 47 aa, Anthopleura xanthogrammica
GAACFCDSDGPSVSGNTLSGILWLAGCPSGWHNCKAHGPNIGWCCKK

SEQ ID NO: 1259 - protein, 47 aa, Anthopleura xanthogrammica
GVPCLCDSDGPSVRGNSLSGIIWLFGCPSGWHNCRDHGPTIGWCCKK

SEQ ID NO: 1260 - protein, 49 aa, Anthopleura xanthogrammica
GVSCLCDSDGPSVRGNTLSGILWFYPSGCPSGWHNCKAHGPTIGWCCKQ

SEQ ID NO: 1261 - protein, 48 aa, Bunodosoma cangicum
GVACRCDSDGPTVRGDSLSGTLWLTGGCPSGWHNCRGSGPFIGYCCKK

SEQ ID NO: 1262 - protein, 48 aa, Bunodosoma cangicum
GVACRCDSDGPTVHGDSLSGTLWLTGGCPSGWHNCRGSGPFIGYCCKK

SEQ ID NO: 1263 - protein, 33 aa, Pandinus imperator
GDCLPHLKRCKADNDCCGKKCKRRGTNAEKRCR

SEQ ID NO: 1264 - protein, 32 aa, Centruroides noxius
VACVYRTCDKDCTSRKYRSGKCINNACKCYPY

SEQ ID NO: 1265 - protein, 37 aa, Parabuthus villosus
DEEPKESCSDEMCVIYCKGEEYSTGVCDGPQKCKCSD

SEQ ID NO: 1266 - protein, 37 aa, Parabuthus villosus
DEEPKETCSDEMCVIYCKGEEYSTGVCDGPQKCKCSD

SEQ ID NO: 1267 - protein, 36 aa, Parabuthus granulatus
DEEPKETCSDDMCVIYCKGEEFSTGACDGPQKCKCS

SEQ ID NO: 1268 - protein, 40 aa, Tityus serrulatus
WCSTCLDLACGASRECYDPCFKAFGRAHGKCMNNKCRCYT

SEQ ID NO: 1269 - protein, 40 aa, Tityus trivittatus; identical to SEQ ID NO: 1268

SEQ ID NO: 1270 - protein, 40 aa, Tityus costatus
WCSTCLDLECGASRECYDPCFKAFGRAHGKCMNNKCRCYT

SEQ ID NO: 1271 - protein, 37 aa, Androctonus australis
QNETNKKCQGGSCASVCRRVIGVAAGKCINGRCVCYP

SEQ ID NO: 1272 - protein, 37 aa, Androctonus mauretanicus mauretanicus
QIETNKKCQGGSCASVCRKVIGVAAGKCINGRCVCYP

SEQ ID NO: 1273 - protein, 38 aa, Tityus discrepans
QIDTNVKCSGSSKCVKICIDRYNTRGAKCINGRCTCYP

SEQ ID NO: 1274 - protein, 36 aa, Mesobuthus tamulus
DLIDVKCISSQECWIACKKVTGRFEGKCQNRQCRCY

SEQ ID NO: 1275 - protein, 31 aa, Mesobuthus martensii
AACYSSDCRVKCVAMGFSSGKCINSKCKCYK

SEQ ID NO: 1276 - protein, 37 aa, Mesobuthus tamulus
QFTDVDCSVSKECWSVCKDLFGVDRGKCMGKKCRCYQ

SEQ ID NO: 1277 - protein, 37 aa, Centruroides limbatus
  MISC_FEATURE (37)..(37): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
VFIDVSCSVSKECWAPCKAAVGTDRGKCMGKKCRCYX

SEQ ID NO: 1278 - protein, 36 aa, Leiurus quinquestriatus hebraeus
GLIDVRCYDSRQCWIACKKVTGSTQGKCQNKQCRCY

SEQ ID NO: 1279 - protein, 36 aa, Centruroides limbatus
HFIDVKCTTSKECWPPCKAATGKAAGKCMNKKCKCQ

SEQ ID NO: 1280 - protein, 37 aa, Parabuthus transvaalicus
EVDMRCKSSKECLVKCKQATGRPNGKCMNRKCKCYPR

SEQ ID NO: 1281 - protein, 37 aa, Centruroides noxius
TFIDVDCTVSKECWAPCKAAFGVDRGKCMGKKCKCYV

SEQ ID NO: 1282 - protein, 37 aa, Leiurus quinquestriatus hebraeus
QFTNVSCTTSKECWSVCEKLYNTSRGKCMNKKCRCYS

SEQ ID NO: 1283 - protein, 39 aa, Centruroides noxius
TIINVKCTSPKQCSKPCKELYGSSAGAKCMNGKCKCYNN

SEQ ID NO: 1284 - protein, 39 aa, Centruroides margaritatus
TIINVKCTSPKQCLPPCKAQFGQSAGAKCMNGKCKCYPH

SEQ ID NO: 1285 - protein, 38 aa, Centruroides limpidus limpidus
ITINVKCTSPQQCLRPCKDRFGQHAGGKCINGKCKCYP

SEQ ID NO: 1286 - protein, 38 aa, Centruroides noxius
TIINEKCFATSQCWTPCKKAIGSLQSKCMNGKCKCYNG

SEQ ID NO: 1287 - protein, 39 aa, Centruroides limbatus
TVIDVKCTSPKQCLPPCKAQFGIRAGAKCMNGKCKCYPH

SEQ ID NO: 1288 - protein, 34 aa, Centruroides limbatus
  MISC_FEATURE (23)..(23): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
TFINVKCTSPKQCLPACKEKFGXAAGKCMNGKCK

SEQ ID NO: 1289 - protein, 36 aa, Centruroides limpidus limpidus
TVIDVKCTSPKQCLPPCKEIYGRHAGAKCMNGKCKC

SEQ ID NO: 1290 - protein, 39 aa, Centruroides elegans
TVINVKCTSPKQCLKPCKDLYGPHAGAKCMNGKCKCYNN

SEQ ID NO: 1291 - protein, 39 aa, Centruroides elegans
TIINVKCTSPKQCLKPCKDLYGPHAGAKCMNGKCKCYNN

SEQ ID NO: 1292 - protein, 39 aa, Centruroides elegans
TIINVKCTSPKQCLLPCKEIYGIHAGAKCMNGKCKCYKI

SEQ ID NO: 1293 - protein, 39 aa, Centruroides elegans
TIINVKCTSPKQCLPPCKEIYGRHAGAKCMNGKCHCSKI

SEQ ID NO: 1294 - protein, 39 aa, Centruroides elegans; identical to SEQ ID NO: 1293

SEQ ID NO: 1295 - protein, 38 aa, Androctonus mauretanicus mauretanicus
GVEINVKCSGSPQCLKPCKDAGMRFGKCMNRKCHCTPK

SEQ ID NO: 1296 - protein, 38 aa, Leiurus quinquestriatus hebraeus
GVPINVSCTGSPQCIKPCKDAGMRFGKCMNRKCHCTPK

SEQ ID NO: 1297 - protein, 38 aa, Leiurus quinquestriatus hebraeus
GVPINVPCTGSPQCIKPCKDAGMRFGKCMNRKCHCTPK

SEQ ID NO: 1298 - protein, 38 aa, Leiurus quinquestriatus hebraeus
GVPINVKCTGSPQCLKPCKDAGMRFGKCINGKCHCTPK

SEQ ID NO: 1299 - protein, 38 aa, Orthochirus scrobiculosus
GVIINVKCKISRQCLEPCKKAGMRFGKCMNGKCHCTPK

SEQ ID NO: 1300 - protein, 38 aa, Buthus sindicus
GVPINVKCRGSPQCIQPCRDAGMRFGKCMNGKCHCTPQ

SEQ ID NO: 1301 - protein, 37 aa, Buthus occitanus tunetanus
VGIPVSCKHSGQCIKPCKDAGMRFGKCMNRKCDCTPK

SEQ ID NO: 1302 - protein, 37 aa, Tityus serrulatus
VFINAKCRGSPECLPKCKEAIGKAAGKCMNGKCKCYP

SEQ ID NO: 1303 - protein, 37 aa, Tityus discrepans
VFINVKCTGSKQCLPACKAAVGKAAGKCMNGKCKCYT

SEQ ID NO: 1304 - protein, 37 aa, Tityus cambridgei
VFINVKCRGSKECLPACKAAVGKAAGKCMNGKCKCYP

SEQ ID NO: 1305 - protein, 31 aa, Leiurus quinquestriatus hebraeus
AFCNLRMCQLSCRSLGLLGKCIGDKCECVKH

SEQ ID NO: 1306 - protein, 31 aa, Androctonus mauretanicus mauretanicus
TVCNLRRCQLSCRSLGLLGKCIGVKCECVKH

SEQ ID NO: 1307 - protein, 31 aa, Mesobuthus tamulus
AFCNLRRCELSCRSLGLLGKCIGEECKCVPY

SEQ ID NO: 1308 - protein, 31 aa, Mesobuthus tamulus
AFCNLRRCELSCRSLGLLGKCIGEECKCVPH

SEQ ID NO: 1309 - protein, 35 aa, Pandinus imperator
LVKCRGTSDCGRPCQQQTGCPNSKCINRMCKCYGC

SEQ ID NO: 1310 - protein, 34 aa, Scorpio maurus palmatus
VSCTGSKDCYAPCRKQTGCPNAKCINKSCKCYGC

SEQ ID NO: 1311 - protein, 34 aa, Heterometrus spinifer
ASCRTPKDCADPCRKETGCPYGKCMNRKCKCNRC

SEQ ID NO: 1312 - protein, 35 aa, Anuroctonus phaiodactylus
QKECTGPQHCTNFCRKNKCTHGKCMNRKCKCFNCK

SEQ ID NO: 1313 - protein, 34 aa, Heterometrus spinifer
IRCSGSRDCYSPCMKQTGCPNAKCINKSCKCYGC

SEQ ID NO: 1314 - protein, 36 aa, Hadrurus gertschi
TGTSCISPKQCTEPCRAKGCKHGKCMNRKCHCMLCL

SEQ ID NO: 1315 - protein, 35 aa, Pandinus imperator
TISCTNEKQCYPHCKKETGYPNAKCMNRKCKCFGR

SEQ ID NO: 1316 - protein, 42 aa, Centruroides elegans
DRDSCVDKSRCAKYGYYQECTDCCKKYGHNGGTCMFFKCKCA

SEQ ID NO: 1317 - protein, 42 aa, Centruroides gracilis
DRDSCVDKSRCAKYGHYQECTDCCKKYGHNGGTCMFFKCKCA

SEQ ID NO: 1318 - protein, 42 aa, Centruroides sculpturatus
DRDSCVDKSRCAKYGYYQECQDCCKKAGHNGGTCMFFKCKCA

SEQ ID NO: 1319 - protein, 42 aa, Centruroides limpidus limpidus
DRDSCVDKSRCSKYGYYQECQDCCKKAGHNGGTCMFFKCKCA

SEQ ID NO: 1320 - protein, 42 aa, Centruroides exilicauda
DRDSCVDKSRCAKYGYYQECQDCCKKAGHSGGTCMFFKCKCA

SEQ ID NO: 1321 - protein, 43 aa, Centruroides noxius
DRDSCVDKSKCGKYGYYQECQDCCKNAGHNGGTCVYYKCKCNP

SEQ ID NO: 1322 - protein, 36 aa, Buthus eupeus
MCMPCFTTRPDMAQQCRACCKGRGKCFGPQCLCGYD

SEQ ID NO: 1323 - protein, 35 aa, Buthus sindicus
RCKPCFTTDPQMSKKCADCCGGKGKGKCYGPQCLC

SEQ ID NO: 1324 - protein, 36 aa, Buthus eupeus
MCMPCFTTDHQTARRCRDCCGGRGRKCFGQCLCGYD

SEQ ID NO: 1325 - protein, 35 aa, Buthus eupeus
MCMPCFTTDHNMAKKCRDCCGGNGKCFGPQCLCNR

SEQ ID NO: 1326 - protein, 35 aa, Buthus eupeus
MCMPCFTTDPNMAKKCRDCCGGNGKCFGPQCLCNR

SEQ ID NO: 1327 - protein, 36 aa, Buthus occitanus tunetanus
  MISC_FEATURE (32)..(32): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (33)..(33): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
VRDAYIAQNYNCVYTCFKNDYCNDICTKNGAXXGYC

SEQ ID NO: 1328 - protein, 38 aa, Leiurus quinquestriatus hebraeus
RCSPCFTTDQQMTKKCYDCCGGKGKGKCYGPQCICAPY

SEQ ID NO: 1329 - protein, 33 aa, Buthus occitanus tunetanus
AEIKVRDGYIVYPNNCVYHCGLDPYCNDLCTGA

SEQ ID NO: 1330 - protein, 33 aa, Scorpio maurus palmatus; identical to SEQ ID NO: 722

SEQ ID NO: 1331 - protein, 36 aa, Buthus sindicus
CGPCFTKDPETEKKCATCCGGIGRCFGPQCLCNRGY

SEQ ID NO: 1332 - protein, 36 aa, Leiurus quinquestriatus quinquestriatus
MCMPCFTTDHQMARKCDDCCGGKGRGKCYGPQCLCR

SEQ ID NO: 1333 - protein, 35 aa, Androctonus mauretanicus mauretanicus
CGPCFTTDPYTESKCATCCGGRGKCVGPQCLCNRI

SEQ ID NO: 1334 - protein, 35 aa, Buthus eupeus
MCMPCFTTDPNMANKCRDCCGGGKKCFGPQCLCNR

SEQ ID NO: 1335 - protein, 35 aa, Hemiscorpius lepturus
IKCTLSKDCYSPCKKETGCPRAKCINRNCKCYGCS

SEQ ID NO: 1336 - protein, 34 aa, Leiurus quinquestriatus hebraeus
CGPCFTTDHQMEQKCAECCGGIGKCYGPQCLCNR

SEQ ID NO: 1337 - protein, 70 aa, Androctonus australis; identical to SEQ ID NO: 645

SEQ ID NO: 1338 - protein, 72 aa, Anuroctonus phaiodactylus
KFIRHKDESFYECGQLIGYQQYCVNACQAHGSKEKGYCKGMAPFGLPGGCYCPKLPSNRVKMCFGALESKCA

SEQ ID NO: 1339 - protein, 61 aa, Buthacus arenicola; identical to SEQ ID NO: 699

SEQ ID NO: 1340 - protein, 65 aa, Bothus occitanus tunetanus; identical to SEQ ID NO: 676

SEQ ID NO: 1341 - protein, 60 aa, Bothus occitanus tunetanus; identical to SEQ ID NO: 701

SEQ ID NO: 1342 - protein, 64 aa, Buthus martensii; identical to SEQ ID NO: 681

SEQ ID NO: 1343 - protein, 64 aa, Buthus martensii; identical to SEQ ID NO: 682

SEQ ID NO: 1344 - protein, 64 aa, Buthus martensii; identical to SEQ ID NO: 683

SEQ ID NO: 1345 - protein, 66 aa, Buthus martensii; identical to SEQ ID NO: 684

SEQ ID NO: 1346 - protein, 72 aa, Buthus martensii
KKNGYAVDSSGKVAECLFNNYCNNECTKVYYADKGYCCLLKCYCFGLADDKPVLDIWDSTKNYCDVQIIDLS

SEQ ID NO: 1347 - protein, 66 aa, buthus occitanus mardochei; identical to SEQ ID NO: 679

SEQ ID NO: 1348 - protein, 65 aa, buthus occitanus mardochei; identical to SEQ ID NO: 680

SEQ ID NO: 1349 - protein, 64 aa, Hottentotta judaica; identical to SEQ ID NO: 677

SEQ ID NO: 1350 - protein, 76 aa, Hottentotta judaicus
KKNGYPLDRNGKTTECSGVNAIAPHYCNSECTKVYYAESGYCCWGACYCFGLEDDKPIGPMKDITKKYCDVQIIPS

SEQ ID NO: 1351 - protein, 61 aa, Hottentotta judaicus; identical to SEQ ID NO: 649

SEQ ID NO: 1352 - protein, 64 aa, Leiurus quinquestriatus hebraeus; identical to SEQ ID NO: 674

SEQ ID NO: 1353 - protein, 63 aa, Leiurus quinquestriatus hebraeus; identical to SEQ ID NO: 702

SEQ ID NO: 1354 - protein, 61 aa, Leiurus quinquestriatus hebraeus; identical to SEQ ID NO: 696

SEQ ID NO: 1355 - protein, 60 aa, Leiurus quinquestriatus hebraeus; identical to SEQ ID NO: 697

SEQ ID NO: 1356 - protein, 70 aa, Leiurus quinquestriatus hebraeus; identical to SEQ ID NO: 694

SEQ ID NO: 1357 - protein, 67 aa, Leiurus quinquestriatus hebraeus; identical to SEQ ID NO: 678

SEQ ID NO: 1358 - protein, 64 aa, Leiurus quinquestriatus hebraeus; identical to SEQ ID NO: 685

SEQ ID NO: 1359 - protein, 66 aa, Leiurus quinquestriatus hebraeus; identical to SEQ ID NO: 686

SEQ ID NO: 1360 - protein, 70 aa, Leiurus quinquestriatus quinquestriatus; identical to SEQ ID NO: 693

SEQ ID NO: 1361 - protein, 61 aa, Leiurus quinquestriatus quinquestriatus; identical to SEQ ID NO: 648

SEQ ID NO: 1362 - protein, 64 aa, Leiurus quinquestriatus quinquestriatus; identical to SEQ ID NO: 675

SEQ ID NO: 1363 - protein, 65 aa, Odonthobuthus doriae
GVRDAYIADDKNCVYTCASNGYCNTECTKNGAESGYCQWIGRYGNACWCIKLPDEVPIRIPGKCR

SEQ ID NO: 1364 - protein, 61 aa, Tityus serrulatus
KEGYLMDHEGCKLSCFIRPSGYCGRECGIKKGSSGYCAWPACYCYGLPNWVKVWDRATNKC

SEQ ID NO: 1365 - protein, 64 aa, Tityus zulianus; identical to SEQ ID NO: 704

SEQ ID NO: 1366 - protein, 681 aa, Bacillus thuringiensis
MGGIDMNPYQNKNEYEIFNAPSNGFSKSNNYSRYPLANKPNQPLKNTNYKDWLNVCQDNQQYGNNAGNFASSETIVGVSAGIIVVGTMLGAFAAPVLAAGIISFGTLLPIFWQGSDPANVWQDLLNIGGRPIQEIDKNIINVLTSIVTPIKNQLDKYQEFFDKWEPARTHANAKAVHDLFTTLEPIIDKDLDMLKNNASYRIPTLPAYAQIATWHLNLLKHAATYYNIWLQNQGINPSTFNSSNYYQGYLKRKIQEYTDYCIQTYNAGLTMIRTNTNATWNMYNTYRLEMTLTVLDLIAIFPNYDPEKYPIGVKSELIREVYTNVNSDTFRTITELENGLTRNPTLFTWINQGRFYTRNSRDILDPYDIFSFTGNQMAFTHTNDDRNIIWRAVHGNIISQDTSKVFPFYRNKPIDKVEIVRHREYSDIIYEMIFFSNSSEVFRYSSNSTIENNYKRTDSYMIPKQTWKNEEYGHTLSYIKTDNYIFSVVRERRRVAFSWTHTSVDFQNTIDLDNITQIHALKTLKVSSNSKIVKGLGHTSENLVILKDSMNFRVRFLKNVSQQYQVRIRYATNAPKTTVFLTGIDTISVELPSTTSRQNPNATDLTYADFGYVTFSRTVSNKTFEGEDTFINDLYYGTPNHSYNIYIDKIEFIPITQSVLDYTEKQNIEKTQKIVNDLFVN

SEQ ID NO: 1367 - protein, 681 aa, Bacillus thuringiensis; identical to SEQ ID NO: 1366

SEQ ID NO: 1368 - protein, 1176 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEGQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVQLLLMEE

SEQ ID NO: 1369 - protein, 1176 aa, Bacillus thuringiensis; identical to SEQ ID NO: 1368

SEQ ID NO: 1370 - protein, 1176 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFSNYDSRRYPIRTVSQLTREIYTNPVLENFDGSFRGMAQRIEQNIRQPHLMDILNSITIYTDVHRGFNYWSGHQITASPVGFSGPEFAFPLFGNAGNAAPPVLVSLTGLGIFRTLSSPLYRRIILGSGPNNQELFVLDGTEFSFASLTTNLPSTIYRQRGTVDSLDVIPPQDNSVPPRAGFSHRLSHVTMLSQAAGAVYTLRAPTFSWQHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSEERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVLPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 1371 - protein, 3826 aa, Bacillus thuringiensis
CCTGGGTCAAAAATTGATATTTAGTAAAATTAGTTGCACTTTGTGCATTTTTTCATAAGATGAGTCATATGTTTTAAATTGTAGTAATGAAAAACAGTATTATATCATAATGAATTGGTATCTTAATAAAAGAGATGGAGGTAACTTATGGATAACAATCCGAACATCAATGAATGCATTCCTTATAATTGTTTAAGTAACCCTGAAGTAGAAGTATTAGGTGGAGAAAGAATAGAAACTGGTTACACCCCAATCGATATTTCCTTGTCGCTAACGCAATTTCTTTTGAGTGAATTTGTTCCCGGTGCTGGATTTGTGTTAGGACTAGTTGATATAATATGGGGAATTTTTGGTCCCTCTCAATGGGACGCATTTCTTGTACAAATTGAACAGTTAATTAACCAAAGAATAGAAGAATTCGCTAGGAACCAAGCCATTTCTAGATTAGAAGGACTAAGCAATCTTTATCAAATTTACGCAGAATCTTTTAGAGAGTGGGAAGCAGATCCTACTAATCCAGCATTAAGAGAAGAGATGCGTATTCAATTCAATGACATGAACAGTGCCCTTACAACCGCTATTCCTCTTTTGGCAGTTCAAAATTATCAAGTTCCTCTTTTATCAGTATATGTTCAAGCTGCAAATTTACATTTATCAGTTTTGAGAGATGTTTCAGTGTTTGGACAAAGGTGGGGATTTGATGCCGCGACTATCAATAGTCGTTATAATGATTTAACTAGGCTTATTGGCAACTATACAGATTATGCTGTGCGCTGGTACAATACGGGATTAGAGCGTGTATGGGGACCGGATTCTAGAGATTGGGTAAGGTATAATCAATTTAGAAGAGAGCTAACACTTACTGTATTAGATATCGTTGCTCTATTCTCAAATTATGATAGTCGAAGGTATCCAATTCGAACAGTTTCCCAATTAACAAGAGAAATTTATACGAACCCAGTATTAGAAAATTTTGATGGTAGTTTTCGTGGAATGGCTCAGAGAATAGAACAGAATATTAGGCAACCACATCTTATGGATATCCTTAATAGTATAACCATTTATACTGATGTGCATAGAGGCTTTAATTATTGGTCAGGGCATCAAATAACAGCTTCTCCTGTAGGGTTTTCAGGACCAGAATTCGCATTCCCTTTATTTGGGAATGCGGGGAATGCAGCTCCACCCGTACTTGTCTCATTAACTGGTTTGGGGATTTTTAGAACATTATCTTCACCTTTATATAGAAGAATTATACTTGGTTCAGGCCCAAATAATCAGGAACTGTTTGTCCTTGATGGAACGGAGTTTTCTTTTGCCTCCCTAACGACCAACTTGCCTTCCACTATATATAGACAAAGGGGTACAGTCGATTCACTAGATGTAATACCGCCACAGGATAATAGTGTACCACCTCGTGCGGGATTTAGCCATCGATTGAGTCATGTTACAATGCTGAGCCAAGCAGCTGGAGCAGTTTACACCTTGAGAGCTCCAACGTTTTCTTGGCAGCATCGCAGTGCTGAATTTAATAATATAATTCCTTCATCACAAATTACACAAATACCTTTAACAAAATCTACTAATCTTGGCTCTGGAACTTCTGTCGTTAAAGGACCAGGATTTACAGGAGGAGATATTCTTCGAAGAACTTCACCTGGCCAGATTTCAACCTTAAGAGTAAATATTACTGCACCATTATCACAAAGATATCGGGTAAGAATTCGCTACGCTTCTACTACAAATTTACAATTCCATACATCAATTGACGGAAGACCTATTAATCAGGGTAATTTTTCAGCAACTATGAGTAGTGGGAGTAATTTACAGTCCGGAAGCTTTAGGACTGTAGGTTTTACTACTCCGTTTAACTTTTCAAATGGATCAAGTGTATTTACGTTAAGTGCTCATGTCTTCAATTCAGGCAATGAAGTTTATATAGATCGAATTGAATTTGTTCCGGCAGAAGTAACCTTTGAGGCAGAATATGATTTAGAAAGAGCACAAAAGGCGGTGAATGAGCTGTTTACTTCTTCCAATCAAATCGGGTTAAAAACAGATGTGACGGATTATCATATTGATCAAGTATCCAATTTAGTTGAGTGTTTATCAGATGAATTTTGTCTGGATGAAAAACAAGAATTGTCCGAGAAAGTCAAACATGCGAAGCGACTTAGTGATGAGCGGAATTTACTTCAAGATCCAAACTTCAGAGGGATCAATAGACAACTAGACCGTGGCTGGAGAGGAAGTACGGATATTACCATCCAAGGAGGCGATGACGTATTCAAAGAGAATTACGTTACGCTATTGGGTACCTTTGATGAGTGCTATCCAACGTATTTATATCAAAAAATAGATGAGTCGAAATTAAAAGCCTATACCCGTTATCAATTAAGAGGGTATATCGAAGATAGTCAAGACTTAGAAATCTATTTAATTCGCTACAATGCAAAACATGAAACAGTAAATGTGCCAGGTACGGGTTCCTTATGGCCGCTTTCAGCCCAAAGTCCAATCGGAAAGTGTGGAGAGCCGAATCGATGCGCGCCACACCTTGAATGGAATCCTGACTTAGATTGTTCGTGTAGGGATGGAGAAAAGTGTGCCCATCATTCGCATCATTTCTCCTTAGACATTGATGTAGGATGTACAGACTTAAATGAGGACCTAGGTGTATGGGTGATCTTTAAGATTAAGACGCAAGATGGGCACGCAAGACTAGGGAATCTAGAGTTTCTCGAAGAGAAACCATTAGTAGGAGAAGCGCTAGCTCGTGTGAAAAGAGCGGAGAAAAAATGGAGAGACAAACGTGAAAAATTGGAATGGGAAACAAATATCGTTTATAAAGAGGCAAAAGAATCTGTAGATGCTTTATTTGTAAACTCTCAATATGATCAATTACAAGCGGATACGAATATTGCCATGATTCATGCGGCAGATAAACGTGTTCATAGCATTCGAGAAGCTTATCTGCCTGAGCTGTCTGTGATTCCGGGTGTCAATGCGGCTATTTTTGAAGAATTAGAAGGGCGTATTTTCACTGCATTCTCCCTATATGATGCGAGAAATGTCATTAAAAATGGTGATTTTAATAATGGCTTATCCTGCTGGAACGTGAAAGGGCATGTAGATGTAGAAGAACAAAACAACCAACGTTCGGTCCTTGTTGTTCCGGAATGGGAAGCAGAAGTGTCACAAGAAGTTCGTGTCTGTCCGGGTCGTGGCTATATCCTTCGTGTCACAGCGTACAAGGAGGGATATGGAGAAGGTTGCGTAACCATTCATGAGATCGAGAACAATACAGACGAACTGAAGTTTAGCAACTGCGTAGAAGAGGAAATCTATCCAAATAACACGGTAACGTGTAATGATTATACTGTAAATCAAGAAGAATACGGAGGTGCGTACACTTCTCGTAATCGAGGATATAACGAAGCTCCTTCCGTACCAGCTGATTATGCGTCAGTCTATGAAGAAAAATCGTATACAGATGGACGAAGAGAGAATCCTTGTGAATTTAACAGAGGGTATAGGGATTACACGCCACTACCAGTTGGTTATGTGACAAAAGAATTAGAATACTTCCCAGAAACCGATAAGGTATGGATTGAGATTGGAGAAACGGAAGGAACATTTATCGTGGACAGCGTGGAATTACTCCTTATGGAGGAATAGTCTCATGCAAACTCAGGTTTAAATATCGTTTTCAAATCAATTGTCCAAGAGCAGCATTACAAATAGATAAGTAATTTGTTGTAATGAAAAACGGACATCACCTCCATTGAAACGGAGTGATGTCCGTTTTACTATGTTATTTTCTAGT

SEQ ID NO: 1372 - protein, 1156 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHERLGNLEFLEGRAPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1373 - protein, 2815 aa, Bacillus thuringiensis
AAATTGTAGTAATGAAAAACAGTATTATATCATAATGAATTGGTATCTTAATAAAAGAGATGGAGGTAACTTATGGATAACAATCCGAACATCAATGAATGCATTCCTTATAATTGTTTAAGTAACCCTGAAGTAGAAGTATTAGGTGGAGAAAGAATAGAAACTGGTTACACCCCAATCGATATTTCCTTGTCGCTAACGCAATTTCTTTTGAGTGAATTTGTTCCCGGTGCTGGATTTGTGTTAGGACTAGTTGATATAATATGGGGAATTTTTGGTCCCTCTCAATGGGACGCATTTCTTGTACAAATTGAACAGTTAATTAACCAAAGAATAGAAGAATTCGCTAGGAACCAAGCCATTTCTAGATTAGAAGGACTAAGCAATCTTTATCAAATTTACGCAGAATCTTTTAGAGAGTGGGAAGCAGATCCTACTAATCCAGCATTAAGAGAAGAGATGCGTATTCAATTCAATGACATGAACAGTGCCCTTACAACCGCTATTCCTCTTTTTGCAGTTCAAAATTATCAAGTTCCTCTTTTATCAGTATATGTTCAAGCTGCAAATTTACATTTATCAGTTTTGAGAGATGTTTCAGTGTTTGGACAAAGGTGGGGATTTGATGCCGCGACTATCAATAGTCGTTATAATGATTTAACTAGGCTTATTGGCAACTATACAGATCATGCTGTACGCTGGTACAATACGGGATTAGAGCGTGTATGGGGACCGGATTCTAGAGATTGGATAAGATATAATCAATTTAGAAGAGAATTAACACTAACTGTATTAGATATCGTTTCTCTATTTCCGAACTATGATAGTAGAACGTATCCAATTCGAACAGTTTCCCAATTAACAAGAGAAATTTATACAAACCCAGTATTAGAAAATTTTGATGGTAGTTTTCGAGGCTCGGCTCAGGGCATAGAAGGAAGTATTAGGAGTCCACATTTGATGGATATACTTAACAGTATAACCATCTATACGGATGCTCATAGAGGAGAATATTATTGGTCAGGGCATCAAATAATGGCTTCTCCTGTAGGGTTTTCGGGGCCAGAATTCACTTTTCCGCTATATGGAACTATGGGAAATGCAGCTCCACAACAACGTATTGTTGCTCAACTAGGTCAGGGCGTGTATAGAACATTATCGTCCACTTTATATAGAAGACCTTTTAATATAGGGATAAATAATCAACAACTATCTGTTCTTGACGGGACAGAATTTGCTTATGGAACCTCCTCAAATTTGCCATCCGCTGTATACAGAAAAAGCGGAACGGTAGATTCGCTGGATGAAATACCGCCACAGAATAACAACGTGCCACCTAGGCAAGGATTTAGTCATCGATTAAGCCATGTTTCAATGTTTCGTTCAGGCTTTAGTAATAGTAGTGTAAGTATAATAAGAGCTCCTATGTTCTCTTGGATACATCGTAGTGCTGAATTTAATAATATAATTCCTTCATCACAAATTACACAAATACCTTTAACAAAATCTACTAATCTTGGCTCTGGAACTTCTGTCGTTAAAGGACCAGGATTTACAGGAGGAGATATTCTTCGAAGAACTTCACCTGGCCAGATTTCAACCTTAAGAGTAAATATTACTGCACCATTATCACAAAGATATCGGGTAAGAATTCGCTACGCTTCTACCACAAATTTACAATTCCATACATCAATTGACGGAAGACCTATTAATCAGGGGAATTTTTCAGCAACTATGAGTAGTGGGAGTAATTTACAGTCCGGAAGCTTTAGGACTGTAGGTTTTACTACTCCGTTTAACTTTTCAAATGGATCAAGTGTATTTACGTTAAGTGCTCATGTCTTCAATTCAGGCAATGAAGTTTATATAGATCGAATTGAATTTGTTCCGGCAGAAGTAACCTTTGAGGCAGAATATGATTTAGAAAGAGCACAAAAGGCGGTGAATGAGCTGTTTACTTCTTCCAATCAAATCGGGTTAAAAACAGATGTGACGGATTATCATATTGATCAAGTATCCAATTTAGTTGAGTGTTTATCTGATGAATTTTGTCTGGATGAAAAAAAAGAATTGTCCGAGAAAGTCAAACATGCGAACGACTTAGTGATGAGCGGAATTTACTTCAAGATCCAAACTTTAGAGGGATCAATAGACAACTAGACCGTGGCTGGAGAGGAAGTACGGATATTACCATCCAAGGAGGCGATGACGTATTCAAAGAGAATTACGTTACGCTATTGGGTACCTTTGATGAGTGCTATCCAACGTATTTATATCAAAAAATAGATGAGTCGAAATTAAAAGCCTATACCCGTTACCAATTAAGAGGGTATATCGAAGATAGTCAAGACTTAGAAATCTATTTAATTCGCTACAATGCCAAACACGAAACAGTAAATGTGCCAGGTACGGGTTCCTTATGGCCGCTTTCAGCCCCAAGTCCAATCGGAAAATGTGCCCATCATTCCCATCATTTCTCCTTGGACATTGATGTTGGATGTACAGACTTAAATGAGGACTTAGGTGTATGGGTGATATTCAAGATTAAGACGCAAGATGGCCATGCAAGACTAGGAAATCTAGAATTTCTCGAAGAGAAACCATTAGTAGGAGAAGCACTAGCTCGTGTGAAAAGAGCGGAGAAAAAATGGAGAGACAAACGTGAAAAATTGGAATGGGAAACAAATATTGTTTATAAAGAGGCAAAAGAATCTGTAGATGCTTTATTTGTAAACTCTCAATATGATAGATTACAAGCGGATACCAACATCGCGATGATTCATGCGGCAGATAAACGCGTTCATAGCATTCGAGA

SEQ ID NO: 1374 - protein, 1181 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYKKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVGIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKQELSEKVKHAKRLSDERNLLQDPNFRGINRQLDRGWRGSTDITIQGGDDVFKENCVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1375 - protein, 859 aa, Bacillus thuringiensis
MDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1376 - protein, 1155 aa, Bacillus thuringiensis; identical to SEQ ID NO: 69

SEQ ID NO: 1377 - protein, 1155 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHRIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNSSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKRETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYGRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1378 - protein, 1181 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGLSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSRYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENSTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVDLLLMEE

SEQ ID NO: 1379 - protein, 1155 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQRWGFDAATINSRYNDLTRLIGNYTDHAVRWYNTGLERVWGPDSRDWIRYNQFRRELTLTVLDIVSLFPNYDSRTYPIRTVSQLTREIYTNPVLENFDGSFRGSAQGIEGSIRSPHLMDILNSITIYTDAHRGEYYWSGHQIMASPVGFSGPEFTFPLYGNMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 1380 - protein, 793 aa, Bacillus thuringiensis
MQCVPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFRAWEADPTNPALRVEMRIQFNDMNSALTTAIPLFAVQNYQVPLLSVYVQAANLHLSVLRDVSVFGQRWGFDATTINSRYNDLTRLIGNYTDYAVRWYNTGLERVWGPDSRDWIRYNQFRRELTLTVLDIVSLFPNYDSRTYPIRTVSQLTREIYTNPVLEDFNGSFRGSAQGIEQSIRSPHLMDILNSITIYTDAHRGYYYWSGHQIMASPVGFSGPEFTFPLYGTMGNAAPQQRIVAQLGQGVYRTLSSTFYRSPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTAGFTTPFNFSNGSSVFTLSAHVFNSGNEVYIDRIEFVPAEVTFEAEYDLERAQKAVNALFTSSNQIGLKTDVTDYHIDQVSNLVECLSDEFCLDEKQELSEKVKHAKRLSDERNLLQDPNFRWINRQLDRGWRGSTDITIQGGDDVFKENYVTLPGTFDECYPTYLYQKIDESKLKAYTRYQLRGYIEDSQDLEIYLIRYNAKHETVNVPGTGSLWPLSAQSPIGRCGEPNR

SEQ ID NO: 1381 - protein, 373 aa, Bacillus thuringiensis; identical to SEQ ID NO: 93

SEQ ID NO: 1382 - protein, 2990 aa, Bacillus thuringiensis
TATGTTTTAAATTGTAGTAATGAAAAACAGTATTATATCATAATGAATTGGTATCTTAATAAAAGAGATGGAGGTAACTTATGGATAACAATCCGAACATCAATGAATGCATTCCTTATAATTGTTTAAGTAACCCTGAAGTAGAAGTATTAGGTGGAGAAAGAATAGAAACTGGTTACACCCCAATCGATATTTCCTTGTCGCTAACGCAATTTCTTTTGAGTGAATTTGTTCCCGGTGCTGGATTTGTGTTAGGACTAGTTGATATAATATGGGGAATTTTTGGTCCCTCTCAATGGGACGCATTTCTTGTACAAATTGAACAGTTAATTAACCAAAGAATAGAAGAATTCGCTAGGAACCAAGCCATTTCTAGATTAGAAGGACTAAGCAATCTTTATCAAATTTACGCAGAATCTTTTAGAGAGTGGGAAGCAGATCCTACTAATCCAGCATTAAGAGAAGAGATGCGTATTCAATTCAATGACATGAACAGTGCCCTTACAACCGCTATTCCTCTTTTGGCAGTTCAAAATTATCAAGTTCCTCTTTTATCAGTATATGTTCAAGCTGCAAATTTACATTTATCAGTTTTGAGAGATGTTTCAGTGTTTGGACAAAGGTGGGGATTTGATGCCGCGACTATCAATAGTCGTTATAATGATTTAACTAGGCTTATTGGCAACTATACAGATTATGCTGTACGCTGGTACAATACGGGATTAGAACGTGTATGGGGACCGGATTCTAGAGATTGGGTAAGGTATAATCAATTTAGAAGAGAATTAACACTAACTGTATTAGATATCGTTGCTCTGTTCCCGAATTATGATAGTAGAAGATATCCAATTCGAACAGTTTCCCAATTAACAAGAGAAATTTATACAAACCCAGTATTAGAAAATTTTGATGGTAGTTTTCGAGGCTCGGCTCAGGGCATAGAAAGAAGTATTAGGAGTCCACATTTGATGGATATACTTAACAGTATAACCATCTATACGGATGCTCATAGGGGTTATTATTATTGGTCAGGGCATCAAATAATGGCTTCTCCTGTCGGGTTTTCGGGGCCAGAATTCACGTTTCCGCTATATGGAACCATGGGAAATGCAGCTCCACAACAACGTATTGTTGCTCAACTAGGTCAGGGCGTGTATAGAACATTATCCTCTACTTTTTATAGAAGACCTTTTAATATAGGGATAAATAATCAACAACTATCTGTTCTTGACGGGACAGAATTTGCTTATGGAACCTCCTCAAATTTGCCATCCGCTGTATACAGAAAAAGCGGAACGGTAGATTCGCTGGATGAAATACCACCACAGAATAACAACGTGCCACCTAGGCAAGGATTTAGTCATCGATTAAGCCATGTTTCAATGTTTCGTTCAGGCTCTAGTAGTAGTGTAAGTATAATAAGAGCTCCTATGTTCTCTTGGATACATCGTAGTGCTGAATTTAATAATATAATTGCATCGGATAGTATTACTCAAATCCCTGCAGTGAAGGGAAACTTTCTTTTTAATGGTTCTGTAATTTCAGGACCAGGATTTACTGGTGGGGACTTAGTTAGATTAAATAGTAGTGGAAATAACATTCAGAATAGAGGGTATATTGAAGTTCCAATTCACTTCCCATCGACATCTACCAGATATCGAGTTCGTGTACGGTATGCTTCTGTAACCCCGATTCACCTCAACGTTAATTGGGGTAATTCATCCATTTTTTCCAATACAGTACCAGCTACAGCTACGTCATTAGATAATCTACAATCAAGTGATTTTGGTTATTTTGAAAGTGCCAATGCTTTTACATCTTCATTAGGTAATATAGTAGGTGTTAGAAATTTTAGTGGGACTGCAGGAGTGATAATAGACAGATTTGAATTTATTCCAGTTACTGCAACACTCGAGGCTGAATATAATCTGGAAAGAGCGCAGAAGGCGGTGAATGCGCTGTTTACGTCTACAAACCAACTAGGGCTAAAAACAAATGTAACGGATTATCATATTGATCAAGTGTCCAATTTAGTTACGTATTTATCGGATGAATTTTGTCTGGATGAAAAGCGAGAATTGTCCGAGAAAGTCAAACATGCGAAGCGACTCAGTGATGAACGCAATTTACTCCAAGATTCAAATTTCAAAGACATTAATAGGCAACCAGAACGTGGGTGGGGCGGAAGTACAGGGATTACCATCCAAGGAGGGGATGACGTATTTAAAGAAAATTACGTCACACTATCAGGTACCTTTGATGAGTGCTATCCAACATATTTGTATCAAAAAATCGATGAATCAAAATTAAAAGCCTTTACCCGTTATCAATTAAGAGGGTATATCGAAGATAGTCAAGACTTAGAAATCTATTTAATTCGCTACAATGCAAAACATGAAACAGTAAATGTGCCAGGTACGGGTTCCTTATGGCCGCTTTCAGCCCAAAGTCCAATCGGAAAGTGTGGAGAGCCGAATCGATGCGCGCCACACCTTGAATGGAATCCTGACTTAGATTGTTCGTGTAGGGATGGAGAAAAGTGTGCCCATCATTCGCATCATTTCTCCTTAGACATTGATGTAGGATGTACAGACTTAAATGAGGACCTAGGTGTATGGGTGATCTTTAAGATTAAGACGCAAGATGGGCACGCAAGACTAGGGAATCTAGAGTTTCTCGAAGAGAAACCATTAGTAGGAGAAGCGCTAGCTCGTGTGAAAAGAGCGGAGAAAAAATGGAGAGACAAACGTGAAAAATTGGAATGGGAAACAAATATCGTTTATAAAGAGGCAAAAGAATCTGTAGATGCTTTATTTGTAAACTCTCAATATGATCAATTACAAGCGGATACGAATATTGCCATGATTCATGCGGCAGATAAACGTGTTCATAGCATTCGAGAAGCTTGGCGTAATCATGGTCATAGCTGTTTCCTGTGTGAAATTGTTATCCGCTCACAATTCCACACAACATACGAGCCGGAAGCATAA

SEQ ID NO: 1383 - protein, 1177 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRSFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTCLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVSGTGSLWPLSAQSPIGKCGEPNRFAPHLEWNPDLDCSCRDGEKCAHHSHHFSLDIDVGCTDLNEDLGVWVIFKIKTQDGHARLGNLEFLGEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVPQEVRVCPGRGYILRVTAYKEGYGEGCVTIHEIENNTDELKFSNCVEEEVYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVQLLLMEE

SEQ ID NO: 1384 - protein, 609 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAIYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTA

SEQ ID NO: 1385 - protein, 609 aa, Bacillus thuringiensis
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDHAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNVLFNGSVISGPGFTGGDLVRLNSSGNNIQNRGYIEVPIHFPSTSTRYRVRVRYASVTPIHLYVNWGNSSIFSNTVPATATSLDNLQSSDFGYFESANAFTSSLGNIVGVRNFSGTAGVIIDRFEFIPVTA

SEQ ID NO: 1386 - protein, 4106 aa, Bacillus thuringiensis
TAGATTTTATATAAGTATAAAAAATAATAAGACTTTAATATAAGTTAAGGGAATACAAATCCTTAATGCATTGGTTAAATATTATAAACTCTAAAGCATGGATGATGGTTGAGAAGTAAGTAGATTATTAACACCCTGGGTCTATTTTAGCCCCAGGGTATAAATTGATATTTAATAAAATCGGTTGCACTTTGAGTATTTTTTCATAGAATGACTCATATGATTAACATTGCAATACAGTAAAAGATCTTTAGTTATAAAGAAAAACTATTACGCTAAAAAGTGGAGGGAACATATGGAGAATAATATTCAAAATCAATGCGTACCTTACAATTGTTTAAGTAATCCTGAGGAGATACTTTTAGATGGAGAAAGAATATCAACTGGTAATTCATCAATTGATATCTCTCTGTCACTTGTCCAGCTTCTGGTATCTAACTTTGTACCAGGGGGAGGATTTTTAGTTGGATTATTAGATTTTGTATGGGGAATAGTAGGCCCTTCTCCATGGGATGCATTTCTAGTGCAAATTGAACAATTAATTAATGAAAGAATAGCTGCATATGCTAGGTCTGCAGCAATTTCTAATTTAGAAGGATTAGGAAACAATTTCAATATATATGTGGAAGCATTTAAAGAATGGGAAGCAGATCCTGATAATCCAGTAACCAGGACTAGAGTAGTTGATCGCTTTCGTATACTTGATGGGCTACTTGAAAGGGACATCCCTTCATTTCGAATTGCTGGATTTGAAGTACCCCTTTTATCCGTTTATGCTCAAGCGGCCAATTTGCATCTAGCTATATTAAGAGATTCTTCAATTTTTGGAGCAAGATGGGGATTGACAACAATAAATGTCAATGAAAACTATAATAGGCTAATTAGGCATATTGATGAATATGCTAATCACTGTGCAGATACGTATAATCGGGGATTAAATAATTTACCAAAATCTACGTATCAAGATTGGATAACATATAATCGATTACGGAGAGACTTAACATTAACTGTATTAGATATCGCTGCTTTCTTTCCAAGCTATGACAATAGGAGATATCCAATTCAGTCAGTTGGTCAACTAACAAGGGAAATTTATACGGACCCATTAATTACTTTTAATCCACAGTTACAGTCTGTAGCTCAATTACCTACTTTTAACGTTATGGAAAGCAACGCAATTAGAACTCCTCATTTATTTGATGTATTGAATAATCTTACAATTTTTACAGATTGGTTTAGTGTTGGACGCAACTTTTATTGGGGAGGACATCGAGTAATATCTAACCGTATAGGAGGAGGTAACATAACATCTCCTATATATGGAAGAGAGGCGAATCAGGAGCCTCCAAGATCTTTTACTTTTAATGGGCCTGTTTTTAGGACTTTATCAAATCCTACTTTTAGACCTTTACAGCAACCTTGGCCAGCGCCACCATTTAATTTACGTGGTGTTGAAGGAGTAGAATTTTCTACACCTTTAAATAGCTTTACGTATCGAGGAAGAGGTACGGTTGATTCTTTAACTGAGTTACCGCCTGAGGATAATAGTGTGCCTCCTCGCGAAGGATATAGTCATCGTTTATGTCATGCAACTTTTGTTCAAAGATCTGGAACCCCATTTTTAACAACTGGTCCAGTATTTTCTTGGACGCATCGTAGTGCTACTGATCGAAATATAATCTACCCGGATGTAATTAACCAAATACCGTTAGTAAAAGCATTCAACCTTACTTCAGGTACCTCTGTAGTCAGAGGTCCAGGATTTACAGGAGGGGATATCATCCGAACTAACGTTAATGGTAGTGTACTAAGTATGAGTCTTAATTTTAGTAACACAACATTACAGCGGTATCGTGTGAGAGTTCGTTATGCTGCTTCTCAAACAATGGTCATGAGCGTAACTGTTGGAGGGAGTACTACTGGTAATCAAGGATTCCCTAGTACTATGAGTGCAAATGGGGCTTTGACATCTCAATCATTTAGATTCGCAGAATTTCCTGTAGGTATTAGTGCATCTGGCAGTCAAGGTGCATCAATAAGTATTAGTAATAATGTAGGTAGACAAATGTTTCACTTAGATAGAATTGAATTTCTCCCAGTTACTTCTACATTTGAGGAGGAATATGATTTAGAAAGAGCGCAAGAGGCGGTGAATGCCCTGTTTACTTCTACGAACCAACTAGGGCTAAAAACAGATGTAACGGATTATCATATTGATCAAGTATCAAATCTAGTTGAATGCTTATCGGATGAATTTTGTCTGGATGAAAAGCGAGAATTGTCTGAGAAAGTCAAACATGCGAAGCGACTCAGCGATGAGCGCAATTTACTCCAGGATCGAAATTTCAGATCCATTAATGGGCAACTAGACCGTGGCTGGAGAGGAAGTACGGATATTACCATCCAAGGTGGAGATGACGTATTCAAAGAGAATTACGTCACACTGCCGGGTACCTTTGATGAGTGCTATCCAACGTATCTATATCAAAAAATAGATGAATCGAAATTAAAATCCTATACACGTTACGAGTTAAGAGGGTATATCGAGGATAGTCAAGATTTAGAAATCTATTTGATTCGCTACAATGCAAAACACGAAATAGTAAATGTACCAGGTACAGGGAGTTTATGGCCTCTTTCTATAGAAAATTCAATTGGGCCTTGTGGAGAACCGAATCGCTGCGCGCCACACCTTGAATGGAATCCTAATCTAGATTGTTCCTGCAGGGACGGGGAAAAATGTGCCCATCATTCCCATCATTTCTCCTTGGACATTGATGTTGGATGTACAGACTTAAATGAGGACTTAGGTGTATGGGTGATCTTCAAGATTAAGACGCAAGATGGCCATGCAAGACTAGGAAATCTAGAGTTTCTCGAAGAGAAACCACTATTAGGGGAAGCACTAGCTCGTGTGAAAAGAGCGGAGAAGAAATGGAGAGACAAACGTGAAAAATTGGAATGGGAAACAAATATTGTTTATAAAGAGGCAAAAGAATCTGTAGATGCTTTATTTGTGAACTCTCAATATGATAGATTACAAGCGGATACGAATATCGCGATGATTCATGCGGCAGATAAACGCGTTCATAGAATTAGAGAAGCATACCTTCCAGAATTATCTGTAATTCCGGGTGTAAATGCGGGCATTTTCGAAGAATTAGAGGGACGCATTTTCACAGCCTACTCTCTATATGATGCGAGAAATGTCATTAAAAATGGCGATTTCAATAATGGTTTATTATGCTGGAACTTGAAAGGGCATGTAGATGTAGAAGAACAAAACAACCATCGTTCAGTCCTTGTTGTCCCGGAATGGGAAGCAGAGGTGTCCCAAGAAGTTCGTGTCTGTCCAGGTCGTGGCTATATCCTTCGTGTTACAGCGTACAAAGAGGGATATGGAGAGGGCTGCGTAACCATTCATGAGATCGAAGACAATACAGACGAACTGAAATTTAGCAACTGTGTTGAAGAGGAAGTATATCCAAACAACACGGTAACGTGTAATGATTATACTGCGACTCAAGAAGAATACGGGGGTGCGTACACTTCCCGTAATCATGGATATGGCAAATCTTATGAAAGTAATTCTTCCGTACAAGCTGATTATGCGTCAGTTTATGAAGAAAAAGCGGACACAGATGGACGAAGAGATAATCATTGCGAATCTAACAGAGGGTATGGGGATTACACGCCACTACCAGCTGGTTATGTAACAAAAGAATTAGAATACTTCCCAGAAACCGATAAGGTATGGGTTGAGATTGGAGAAACGGAAGGAACATTCATTGTGGATAGTGTGGAATTACTCCTTATGGAGGAATAAGGTATGTTTTAAAATGTAGCGTGTGCAAATAAAGAATGTTTACTGACCAGTATTAACAGATAAATAAGAAACTTCTATATAAATAAAAAACGGACATCAATCTTAAGAGAATGATGTCCGTTTTTTGTATGATTTGATTCAACGAGTGATATGTAAATATATTTTTTTGCGAAGTCTTTACATAACAAAAAAATTCGTATAGCAAAATTCTAAATTTAACCTTAAATATAGTTAGGGTGAAAATATGCCAAACTAATTTATTCCGAATGTTAATTCGAAA

SEQ ID NO: 1387 - protein, 1171 aa, Bacillus thuringiensis; identical to SEQ ID NO: 176

SEQ ID NO: 1388 - protein, 4231 aa, Bacillus thuringiensis
GTACCAAATTATAAGAACTTTGGTATTTCAATAAAAGAAAATGGAGGTATTTTATGGAGATAGTGAATAATCAGAATCAATGCGTGCCTTATAATTGTTTAAATAATCCTGAAAATGAGATATTAGATATTGAAAGGTCAAATAGTACTGTAGCAACAAACATCGCCTTGGAGATTAGTCGTCTGCTCGCTTCCGCAACTCCAATAGGGGGGATTTTATTAGGATTGTTTGATGCAATATGGGGGTCTATAGGCCCTTCACAATGGGATTTATTTTTAGAGCAAATTGAGCTATTGATTGACCAAAAAATAGAGGAATTCGCTAGAAACCAGGCAATTTCTAGATTAGAAGGGATAAGCAGTCTGTACGGAATTTATACAGAAGCTTTTAGAGAGTGGGAAGCAGATCCTACTAATCCAGCATTAAAAGAAGAGATGCGTACTCAATTTAATGACATGAACAGTATTCTTGTAACAGCTATTCCTCTTTTTTCAGTTCAAAATTATCAAGTCCCATTTTTATCAGTATATGTTCAAGCTGCAAATTTACATTTATCGGTTTTGAGAGATGTTTCAGTGTTTGGGCAGGCTTGGGGATTTGATATAGCAACAATAAATAGTCGTTATAATGATCTGACTAGACTTATTCCTATATATACAGATTATGCTGTACGCTGGTACAATACGGGATTAGATCGCTTACCACGAACTGGTGGGCTGCGAAACTGGGCAAGATTTAATCAGTTTAGAAGAGAGTTAACAATATCAGTATTAGATATTATTTCTTTTTTCAGAAATTACGATTCTAGATTATATCCAATTCCAACAAGCTCCCAATTAACGCGGGAAGTATATACAGATCCGGTAATTAATATAACTGACTATAGAGTTGGCCCCAGCTTCGAGAATATTGAGAACTCAGCCATTAGAAGCCCCCACCTTATGGACTTCTTAAATAATTTGACCATTGATACGGATTTGATTAGAGGTGTTCACTATTGGGCAGGGCATCGTGTAACTTCTCATTTTACAGGTAGTTCTCAAGTGATAACAACCCCTCAATATGGGATAACCGCAAATGCGGAACCAAGACGAACTATTGCTCCTAGTACTTTTCCAGGTCTTAACCTATTTTATAGAACATTATCAAATCCTTTCTTCCGAAGATCAGAAAATATTACTCCTACCTTAGGGATAAATGTAGTACAGGGAGTAGGGTTCATTCAACCAAATAATGCTGAAGTTCTATATAGAAGTAGGGGGACAGTAGATTCTCTTAATGAGTTACCAATTGATGGTGAGAATTCATTAGTTGGATATAGTCATCGATTAAGTCATGTTACACTAACCAGGTCGTTATATAATACTAATATAACTAGCCTGCCAACATTTGTTTGGACACATCACAGTGCTACTAATACAAATACAATTAATCCAGATATTATTACACAAATACCTTTAGTGAAAGGATTTAGACTTGGTGGTGGCACCTCTGTCATTAAAGGACCAGGATTTACAGGAGGGGATATCCTTCGAAGAAATACCATTGGTGAGTTTGTGTCTTTACAAGTCAATATTAACTCACCAATTACCCAAAGATACCGTTTAAGATTTCGTTATGCTTCCAGTAGGGATGCACGAATTACTGTAGCGATAGGAGGACAAATTAGAGTAGATATGACCCTTGAAAAAACCATGGAAATTGGGGAGAGCTTAACATCTAGAACATTTAGCTATACCAATTTTAGTAATCCTTTTTCATTTAGGGCTAATCCAGATATAATTAGAATAGCTGAAGAACTTCCTATTCGTGGTGGTGAGCTTTATATAGATAAAATTGAACTTATTCTAGCAGATGCAACATTTGAAGAAGAATATGATTTGGAAAGAGCACAGAAGGCGGTGAATGCCCTGTTTACTTCTACAAATCAACTAGGGCTAAAAACAGATGTGACGGATTATCATATTGATCAAGTTTCCAATTTAGTTGAGTGTTTATCGGATGAATTTTGTCTGGATGAAAAGAGAGAATTATCCGAGAAAGTCAAACATGCGAAGCGACTCAGTGATGAACGGAATTTACTTCAAGATTCAAACTTCAGAGGGATCAATAGGCAACCAGACCGTGGCTGGAGAGGAAGCACGGATATTACTATCCAAGGTGGAGATGACGTATTCAAAGAGAATTACGTCACATTACCGGGTACCTTTGATGAGTGCTATCCAACGTATTTATATCAAAAAATAGATGAGTCGAAGTTAAAAGCTTATACCCGCTATGAATTAAGAGGGTATATCGAGGATAGTCAAGACTTAGAAATCTATTTAATTCGCTACAATGCAAAACACGAGACAGTAAACGTGCCAGGTACGGGTTCCTTATGGCCGCTTTCAGCCCAAAGTCCAATCGGAAAGTGTGGAGAACCGAATCGATGCGCGCCACACCTTGAATGGAATCCTAATCTAGATTGCTCCTGCAGAGACGGGGAAAAATGTGCCCATCATTCCCATCATTTCTCCTTGGACATTGATGTTGGATGTACAGACTTAAATGAGGACTTAGGTGTATGGGTGATATTCAAGATTAAGACACAAGATGGCTATGCAAGACTAGGAAATCTAGAGTTTCTCGAAGAGAAACCACTATTAGGGGAAGCACTAGCTCGTGTGAAAAGAGCGGAGAAAAAATGGAGAGACAAATGCGAAAAATTGGAATGGGAAACAAATATTGTTTATAAAGAGGCAAAAGAATCTGTAGATGCTTTATTTGTAAACTCTCAATATGATAGATTACAAGCGGATACGAATATCGCGATGATTCATGCGGCAGATAAACGCGTTCATAGCATTCGAGAAGCGTATCTGCCAGAGCTGTCTGTGATTCCGGGTGTCAATGCGGCTATTTTTGAAGAATTAGAAGGGCGTATTTTCACTGCATTCTCCCTATATGATGCGAGAAATGTCATTAAAAATGGCGATTTCAATAATGGCTTATCATGCTGGAACGTGAAAGGGCATGTAGATGTAGAAGAACAGAACAACCATCGTTCGGTCCTTGTTGTTCCAGAATGGGAAGCAGAAGTGTCACAAGAAGTTCGTGTTTGTCCGGGTCGTGGCTATATCCTTCGTGTTACAGCGTACAAAGAGGGATATGGAGAGGGCTGTGTAACGATTCATGAGATCGAAGACAATACAGACGAACTGAAATTCAGCAACTGTGTAGAAGAGGAAGTATATCCAAACAACACGGTAACGTGTAATAATTATACTGCGACTCAAGAAGAACATGAGGGTACGTACACTTCCCGTAATCGAGGATATGACGAAGCCTATGAAAGCAATTCTTCTGTACATGCGTCAGTCTATGAAGAAAAATCGTATACAGATAGACGAAGAGAGAATCCTTGTGAATCTAACAGAGGATATGGGGATTACACACCACTACCAGCTGGCTATGTGACAAAAGAATTAGAGTACTTCCCAGAAACCGATAAGGTATGGATTGAGATCGGAGAAACGGAAGGAACATTCATCGTGGACAGCGTGGAATTACTTCTTATGGAGGAATAATATATGCTTTAAAATGTAAGGTGTGCAAATAAAGAATGATTACTGACTTGTATTGACAGATAAATAAGGAAATTTTTATATGAATAAAAAACGGGCATCACTCTTAAAAGAATGATGTCCGTTTTTTGTATGATTTAACGAGTGATATTTAAATGTTTTTTTGCGAAGGCTTTACTTAACAAAAAAATTCGTATAGCAAAATTCTAAATTTAACCTTAAATATAGTTAGGGTGAAAATATGCCAAACTAATTTATTCCTAATGTTAATTCGAAACAAATCATAAACAAAAATACAGGTATAAAAAAATTTGTGTAAGACATTTTTTTATACCTGTACTATGAGTGTATTTCCCCTGTTAAAATATTTAATCAAAACTATCATCTTTTTATTATCTTTAGGAATATATGGAGAGTAAAATGAGATTTCATCTAAATAAAAAATAGTAACTACTCAGCCACCTTTTGGTGTCTTTTTTTAATTTTACTAGTTTCATATGCCTCCCATTTGTAAATACTGAGTATATCAAACAGGGGGTGAATAAGATGGTCGATCGAAAACTCATTTTAGATGCATATAAAAAAGGACCTGAAGCTGTTATTTCTTTATTTGAAGAAACATTCTCTAAGTTAGAAAAACGAATTCAAGAACTAGAACACGCTTC

SEQ ID NO: 1389 - protein, 1168 aa, Bacillus thuringiensis
MKNNIQNQCVPYNCLSNPEVEILSEERSTGRLPLDISLSLTRFLLSEFVPGVGVAFGLFDLIWGFITPSEWSLFLLQIEQLIEQRIETLERNRAITTLRGLADSYEVYLEALREWEENPNNAQLREDVRIRFANTDDALITAINNFTLTSFEIPLLSVYVQAANLHLSLLRDAVSFGQGWGLDIATVNNHYNRLINLIHRYTEHCLDTYNQGLENLRGTNTRQWSRFNQFRRELTLTVLDIVALFPNYDARAYPIQTSSQLTREIYTSSVIEDSPVSANIPNGFNRAEFGVRPPHLMDFMNSLFVTAETVRSQTVWGGHLVSSRNTAGNPINFPIYGVFNPGGAIWIADEDPRPFYRTLSDPVFVRGGFGDPHYVLGLRGVGFQQTGTNHTRTFRNSGTIDSLDEIPPQDNSGAPWNDYSHVLNHVTFVRWPGEIAGSDSWRAPMFSWTHRSADRTNIINPNIITQIPAVKAHNLHSGSTVVRGPGFTGGDLLRRTNTGTFADIRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTSQLGLKTNVTGYHIDQVSNLVACLSDEFCLDEKRELSEKVKHAKRLSDKRNLLQDPNFRGINRQPDHGWRGSTDITIQGGDDVFKENYVTLPGTFDECYPTYLYQKIDESKLKAYTRYQLRGYIEDSQDLEIYLIRYNSKHEIVNVPGTGSLWPLSVENQIGPCGEPNRCAPHLEWNPDLHCSCRDGEKCVHHSHHFSLDIDVGCTDLNEDLGVWLIFKIKTQDGHARLGNLEFLEEEPLLGEALGRVKRAEKKWRDKREKLQLETNIVYKEAKESVDALFVNSQYDRLQADTNIAMIHAADKRVHRIREAYLPELSVIPGVNAAIFEELEGRIFTAYSLYDARNVIKNGNFNNGLLCWNVKGHVDVEEQNNHRSVLVVPEWEAEVSQEVRVCPGRGYILRVTAYKEGYGEGCVTIHEVDNNTDELKFSNCEKEQVYPGNTVACNDYNKNHGANACSSRNRGYDESYESNSSIPADYAPVYEEEAYTDGQRGNPCEFNRGHTPLPAGYVTAELEYFPETDTVWVEIGETEGTFIVDSVELLLMEE

SEQ ID NO: 1390 - protein, 719 aa, Bacillus thuringiensis
MKLKNPDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQIYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFSTQPDNGVPRVDFHWKFVTHPIASDNFYYPGYAGIGTQLQDSENELPPEATGQPSYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNM

SEQ ID NO: 1391 - protein, 722 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYPDHCVKWYSTGLNNLRGTNAESWVRYNQFRRDMTLMVLDLVALLPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNMVDA

SEQ ID NO: 1392 - protein, 717 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGEPWPKGKNQWEIFMEHVEEIINQKISTYARNKALTDLKGLGDALAVYHDSLESWVGNRNNTRARSVVKSQYIALELMFVQRLPSFAVSGEEVPLLPIYAQAANLHLLLLRDASIFGKEWRLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRSPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGYIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDSEKAQEKVTALFTSTNPRGLKTDVKDYHIDQVSNLVESLSDEFYLDEKRELFEIVKYAKQLHIER

SEQ ID NO: 1393 - protein, 722 aa, Bacillus thuringiensis
MKLKNQDKHQSFSSNAKVDKISTDSLKNETDIELQNINHEDCLKMSEYENVEPFVSASTIQTGIGIAGKILGTLGVPFAGQVASLYSFILGELWPKGKSQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNHQVERAGDYSDHCVKWYSTGLNNLRGTNAESWVRYNQFRRDMTLMVLDLVALFPSYDIQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLFLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQLHIERNMVDA

SEQ ID NO: 1394 - protein, 147 aa, Bacillus thuringiensis
MKLKNPDKHQSLSSNAKVDKIATDSLKNETDIELKNMNNEDYLRMSEHESIDPFVSASTIQTGIGIAGKILGTLGVPFAGQIASLYSFILGELWPKGKSQWEIFMEHVEEIINQKILTYARNKALSDLRGLGDALAVYHESLESWVE

SEQ ID NO: 1395 - protein, 719 aa, Bacillus thuringiensis
MKLKNPDKHQTLSSNAKVDKIATDSLKNETDIELKNMNNEDYLRMSEHESIDPFVSASTIQTGIGIAGKILGTLGVPFPGQIASLYSFILGELWPKGKSQWEIFMEHVEAIINRKISTYARNKALTDLKGLGDALAVYHESLESWVGNRNNTRARSVVKNQYIALELMFVQKLPSFAVSGEEVPLLPIYAQAANLHLLLLRDASIFEKNGGLSASEISTFYNRQVERTRDYSYHCVKWNNTGLNNLRATNGQSWVRYNQFRKDIELMVLDLVRVFPSYDTLVYPIKTTSQLTREVYTDAIGTVDPNQALRSTTWYNNNAPSFSAIEAAVIRSPHLLDFLEKVTIYSLLSRWSNTQYMNMWGGHRLESRPIGGALNTSTQGSTNTSINPVTLQFTSRDFYRTESWAGLNLFLTQPVIGVPRVDFHWKFPTLPIASDNFYYLGYAGVGTQLQDSENELPPETTGQPNYESYSHRLSHIGLISASHVKALVYSWTHRSADRTNTIEPNSITQIPLVKAFNLSSGAAVVRGPGFTGGHILRRTKSGTFGHIRVNINPPFAQRYRVRMSYASTTDLQFHTSINGKAINQGNFSATMNRGEDLDYKTFRTVGFTTPFSFSDVQSTFTIGAWNFSSGNEVYIGRIEFVPVEVTYEAEYDFEKAQEKVTALFTSTNPRGLKTDVKDYHIDQVSNLVESLSDELYLDEKRELFEIVKYAKQIHIERNM

SEQ ID NO: 1396 - protein, 381 aa, Bacillus thuringiensis; identical to SEQ ID NO: 225

SEQ ID NO: 1397 - protein, 150 aa, Bacillus thuringiensis
MEINNQKQCIPYNCLSNPEEVLLDGERILPDIDPLEVSLSLLQFLLNNFVPGGGFISGLVDKIWGALRPSEWDLFLAQIERLIDQRIEATVRAKAITELEGLGRNYQIYAEAFKEWESDPDNEAAKSRVIDRFRILDGLIEANIPSFRII

SEQ ID NO: 1398 - protein, 1170 aa, Bacillus thuringiensis
MEINNQNQCIPYNCLSNPEEVLLDGERILPDIDPLEVSMSLLQFLLNNFVPGGGFISGLFDKIWGALRPSDWELFLAQIEQLIDQRIEATVRAKAIAELEGLGRSFQLYVEAFKEWEETPDNTAARSRVTERFRIIDAQIEANIPSFRIPGFEVPLLSVYAQAANLHLALLRDSVIFGERWGLTTTNVNDIYNRQVKRIHEYSDHCVDTYKTELERLGFTSRAQWKIYNQFRRELTLTVLDIVAVFPNYDGKLYPIQTKSELTREIYTSPVSEYYYGAINNYNQNGIQTERQIRQPHLMDFFNTMTMYTSYNRREYYWSGLEMTAYFTGFAGPQVSFPLAGTRGDAAPPFNVRSVNDGIYRILSAPFYSAPFLGTSVLGSRGEEFMFALNNISPPPSARYRNPGTVDSLVSIPPQDNSVPPHRGSSHRLSHVTMRNSSPIFHWTHRSATTTNRINSDVITQIPMVKAYNLHAGATVVRGPGFTGGDILRRTSNGMVVTLRVDASAVRNQRYRIRFRYAATSNFYFVVRRGNLGVNGREIMKTMSTGEELKSASFVLGEFITPFNFFENQVPLQIEIQSLSPGGEVYLDKIEFIPADTTFEAEYDLERAQKAVNALFTSTNQRGLKTDVTDYHIDQVSNLVECLSDEFCLDEKRELSEKVKHAKRLSDERNLLQDPNFTSINGQLDRGWRGSTDITIQGGNDVFKENYVTLPGTFDECYPTYLYQKIDESKLKAYTRYELRGYIEDSQDLEVYLIRYNAKHETLNVPGTDSLRTLSVESQNGRCGELNRCMPHIKWNPDVDCSCRDGEKCAHHSHHFSLDIDVGCTDLQEDLGVWVVFKIKTQEGYARLGNLEFIEEKPLVGEALSRVKRAEKKWRDKREKLELETKRVYTEAKEAVDALFVDSQYDRLQADTNIGMIHAADKLVHRICETYLPELPFIPGINAIIFEELENRISTAFFLYEARNVINNGDFNNGLTCWNVKGHVDVQQSHHRSVLVIPEWEAEVSQKVRVCPGRGYILRVTAYKEGYGEGCVTIHEIEDNTDELKFRNCEEEGDYSNDTGTCNDYPASQGAAGCADVCNSRNVGYKDAYETNTSASVNYKPTYEEETYTDVREDNHCEYDRGYVNYPPLPAGYVTKELEYFPETDTVWIEIGETEGKFIVDSVELLLMEE

SEQ ID NO: 1399 - protein, 1168 aa, Bacillus thuringiensis; identical to SEQ ID NO: 227

SEQ ID NO: 1400 - protein, 725 aa, Bacillus thuringiensis
  MISC_FEATURE (55)..(55): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (76)..(76): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (477)..(477): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (600)..(600): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (604)..(604): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (619)..(619): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (623)..(623): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  misc_feature (624)..(624): Xaa can be any naturally occurring amino acid
  MISC_FEATURE (636)..(636): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (637)..(637): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (647)..(647): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (653)..(653): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (712)..(712): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MCGFTPTRSREQVAEISLGLTRFLLENLFPGSTFGFGLIDIIWGIFGPDQWSMFXEQIEQLIDQRIETVERNRANXNINWVINSYDVYIEALKEWENNPDNSASQERVRNRFRTTDDALITGIPLLAIPNFEIATLSVYVQAANLHLSLLRDAVFFGERWGLTQINVDDLYRRLTNNIRTNSDHCARWYNEGLDNISGLSRSINFQREVTISVLDIVALFPNYDIRTYPISTTSQLTREIFTSPIVVPNDFSVAYEGVRRAPHLFEFLEKLVIYTGDRSGIRHWAGHEITSRRTDSYHGIIRYPLYGTAANAESPYTLALQPSGSIYRTLSEPIFSQTGGLSPHRRRVVEGVEFSIVNNNVNPSSFVYRRKGSLDSFTELPPEDESVPPYIGYSHQLCHVGFGRTNVIFEPSNFARVPVFSWTHRSATPTNTIDPDRITQIPSVKASSLRNSTVVSGPGFTGGDIVRMGAVHQIYAXDLSMNVRPSVALSRYLIRLRYACRGSSNIVIHGPSIRFVSLPSTMSNDEPLTYQSFRYASITTPITRPIYNMFNLSISRISGVQNLFIDRIEFIPVDANFEAERDLERAQKAVNALFTSTNQXGLKXDVTDYHIDQVSNLVXCLSDXFCLDEKRELSEKXKHAKRLSDEXNLLQDXNFTGINRQVDRGWRGSTDITIQGGNDVFKENYVTLPGTFDECYPTYLYQKIDESKLKPXTRYELRGYIEDSQ

SEQ ID NO: 1401 - protein, 1170 aa, Bacillus thuringiensis; identical to SEQ ID NO: 1398

SEQ ID NO: 1402 - protein, 1167 aa, Bacillus thuringiensis
MTNPTILYPSYHNVLAHPIRLDSFFDPFVETFKDLKGAWEEFGKTGYMDPLKQHLQIAWDTSQNGTVDYLALTKASISLIGLIPGADAVVPFINMFVDFIFPKLFGRGSQQNAQAQFFELIIEKVKELVDEDFRNFTLNNLLNYLDGMQTALSHFQNDVQIAICQGEQPGLMLDQTPTACTPTTDHLISVRESFKDARTTIETALPHFKNPMLSTNDNTPDFNSDTVLLTLPMYTTGATLNLILHQGYIQFAERWKSVNYDESFINQTKVDLQRRIQDYSTTVSTTFEKFKPTLNPSNKESVNKYNRYVRSMTLQSLDIAATWPTLDNVNYPSNVDIQLDQTRLVFSDVAGPWEGNDNITSNIIDVLTPINTGIGFQESSDLRKFTYPRIELQSMQFHGQYVNSKSVEHCYSDGLKLNYKNKTITAGVSNIDESNQNNKHNYGPVINSPITDINVNSQNSQYLDLNSVMVNGGQKVTGCSPLSSNGNSNNAALPNQKINVIYSVQSNDKPEKHADTYRKWGYMSSHIPYDLVPENVIGDIDPDTKQPSLLLKGFPAEKGYGDSIAYVSEPLNGANAVKLTSYQVLQMEVTNQTTQKYRIRIRYATGGDTAASIWFHIIGPSGNDLTNEGHNFSSVSSRNKMFVQGNNGKYVLNILTDSIELPSGQQTILIQNTNSQDLFLDRIEFISLPSTSTPTSTNFVEPESLEKIINQVNQLFSSSSQTELAHTVSDYKIDQVVLKVNALSDDVFGVEKKALRKLVNQAKQLSKARNVLVGGNFEKGHEWALSREATMVANHELFKGDHLLLPPPTLYPSYAYQKIDESKLKSNTRYTVSGFIAQSEHLEVVVSRYGKEVHDMLDIPYEEALPISSDESPNCCKPAACQCSSCDGSQSDSHFFSYSIDVGSLQSDVNLGIEFGLRIAKPNGFAKISNLEIKEDRPLTEKEIKKVQRKEQKWKKAFNQEQAEVATTLQPTLDQINALYQNEDWNGSVHPASDYQHLSAVVVPTLPKQRHWFMEGREGEHVVLTQQFQQALDRAFQQIEEQNLIHNGNLANGLTDWTVTGDAQLTIFDEDPVLELAHWDASISQTIEIMDFEGRHRIQTACTWKRQRNSYRSTWRKRLETMTFNTTSFTTQEQTFYFEGDTVDVHVQSENNTFLIDSVELIEIIEE

SEQ ID NO: 1403 - protein, 1167 aa, Bacillus thuringiensis
MTNPTILYPSYHNVLAHPIRLDSFFDPFVETFKDLKGAWEEFGKTGYMDPLKQHLQIAWDTSQNGTVDYLALTKASISLIGLIPGADAVVPFINMFVDFIFPKLFGRGSQQNAQAQFFELIIEKVKELVDEDFRNFTLNNLLNYLDGMQTALSHFQNDVQIAICQGEQPGLMLDQTPTACTPTTDHLISVRESFKDARTTIETALPHFKNPMLSTNDNTPDFNSDTVLLTLPMYTTAATLNLILHQGYIQFAERWKSVNYDESFINQTKVDLQRRIQDYSTTVSTTFEKFKPTLNPSNKESVNKYNRYVRSMTLQSLDIAATWPTLDNVNYPSNVDIQLDQTRLVFSDVAGPWEGNDNITSNIIDVLTPINTGIGFQESSDLRKFTYPRIELQSMQFHGQYVNSKSVEHCYSDGLKLNYKNKTITAGVSNIDESNQNNKHNYGPVINSPITDINVNSQNSQYLDLNSVMVNGGQKVAGCSPLSSNGNSNNAALPNQKINVIYSVQSNDKPEKHADTYRKWGYMSSHIPYDLVPENVIGDIDPDTKQPSLLLKGFPAEKGYGDSIAYVSEPLNGANAVKLTSYQVLKMEVTNQTTQKYRIRIRYATGGDTAASIWFHIIGPSGNDLTNEGHNFSSVSSRNKMFVQGNNGKYVLNILTDSIELPSGQQTILIQNTNSQDLFLDRIEFISLPSTSTPTSTNFVEPESLEKIINQVNQLFSSSSQTELAHTVSDYKIDQVVLKVNALSDDVFGVEKKALRKLVNQAKQLSKARNVLVGGNFEKGHEWALSREATMVANHELFKGDHLLLPPPTLYPSYAYQKIDESKLKSNTRYTVSGFIAQSEHLEVVVSRYGKEVHDMLDIPYEEALPISSDESPNCCKPAACQCSSCDGSQSDSHFFSYSIDVGSLQSDVNLGIEFGLRIAKPNGFAKISNLEIKEDRPLTEKEIKKVQRKEQKWKKAFNQEQAEVATTLQPTLDQINALYQNEDWNGSVHPHVTYQHLSAVVVPTLPKQRHWFMEDREGEHVVLTQQFQQALDRAFQQIEEQNLIHNGNFANGLTDWTVTGDAQLTIFDEDPVLELAHWDASISQTIEIMDFEEDTEYKLRVRGKGKGTVTVQHGEEELETMTFNTTSFTTQEQTFYFEGDTVDVHVQSENNTFLIDSVELIEIIEE

SEQ ID NO: 1404 - protein, 2172 aa, Bacillus thuringiensis
ATGAAAGAACAAAATCTAAATAAATATGATGAAATAACTGTACAAGCAGCAAGCGATTATATCGACATTCGTCCGATTTTTCAAACAAATGGATCTGCTACATTTAATTCTAATACCAATATTACAACTTTAACACAAGCTATAAATAGTCAAGCAGGAGCAATTGCAGGAAAGACTGCTCTAGATATGAGACATGACTTTACTTTTAGAGCAGATATTTTTCTTGGAACTAAAAGTAACGGAGCAGACGGTATTGCAATCGCATTTCATAGAGGATCAATTGGGTTTGTTGGAACAAAAGGCGGAGGACTTGGAATATTAGGTGCACCTAAAGGGATAGGGTTTGAATTAGACACATATGCGAATGCACCTGAGGACGAAGTAGGCGATTCGTTTGGGCATGGGGCAATGAAAGGATCATTCCCTAGTTTCCCAAATGGATATCCCCATGCTGGCTTTGTAAGTACTGATAAAAATAGTAGATGGTTATCAGCTCTAGCTCAGATGCAGCGAATCGCTGCTCCAAACGGGCGTTGGAGACGTCTGGAGATTCGTTGGGATGCTCGTAATAAAGAGTTAACTGCAAATCTTCAGGATTTAACTTTTAATGACATAACTGTTGGAGAGAAGCCACGTACTCCAAGAACTGCAACTTGGAGGTTAGTAAATCCTGCATTTGAACTTGATCAGAAGTATACTTTTGTTATTGGTTCGGCGACGGGTGCATCTAATAACCTACATCAGATTGGGATTATAGAATTTGATGCATACTTTACTAAACCGACAATAGAAGCGAATAATGTAAATGTCCCAGTGGGAGCAACATTTAATCCAAAAACATATCCAGGAATAAATTTAAGAGCAACAGATGAGATAGATGGGGATTTGACATCGAAGATTATTGTGAAAGCAAACAATGTTAATACGTCGAAAACGGGTGTGTATTATGTGACGTATTATGTAGAGAATAGTTATGGGGAAAGTGATGAAAAAACAATCGAAGTAACTGTGTTTTCAAACCCTACAATTATTGCAAGTGATGTTGAAATTGAAAAAGGGGAATCTTTTAACCCACTAACTGATTCAAGAGTAGGTCTTTCTGCACAGGATTCATTAGGCAATGATATTACCCAAAATGTAAAGGTAAAATCGAGTAATGTGGATACTTCAAAGCCAGGGGAATATGAAGTTGTATTTGAAGTGACAGATAGCTTTGGTGGAAAAGCAGAAAAAGATTTCAAGGTTACAGTTTTAGGACAGCCAAGTATAGAAGCGAATAATGTTGAATTAGAAATAGATGATTCATTGGATCCATTAACAGATGCAAAAGTAGGTCTCCGTGCAAAGGATTCATTAGGTAATGATATTACGAAAGACATAAAAGTAAAGTTCAATAACGTAGATACTTCAAATTCAGGAAAGTATGAAGTTATATTTGAAGTGACGGACCGTTTTGGAAAAAAAGCAGAAAAAAGTATTGAAGTCCTTGTTCTAGGAGAACCAAGCATTGAAGCAAATGATGTTGAGGTTAATAAAGGTGAAACGTTTGAACCATTAACAGATTCAAGAGTTGGCCTCCGTGCAAAAGACTCATTAGGTAATGATATTACGAAAGATGTGAAAATAAAATCAAGTAATGTGGATACTTCAAAACCAGGTGAATATGAAGTTGTATTTGAAGTGACAGATCGTTTTGGTAAATATGTAGAAAAAACAATTGGAGTTATAGTGCCAGTAATTGATGATGAATGGGAAGATGGAAATGTGAATGGTTGGAAATTCTATGCTGGGCAAGATATTAAACTGTTGAAGGATCCTGATAAAGCCTATAAAGGCGATTATGTATTCTATGATTCTAGACACGTTGCTATTTCTAAAACAATTCCACTAACGGATTTGCAAATAAATACAAACTATGAAATTACAGTGTATGCTAAAGCAGAAAGCGGCGATCATCACTTAAAAGTGACGTATAAGAAAGACCCGGCAGGTCCAGAAGAGCCGCCAGTTTTCAATAGACTGATTAGCACAGGCACATTGGTAGAAAAAGATTATAGAGAATTAAAAGGGACGTTCCGCGTAACAGAATTAAACAAAGCACCATTGATAATCGTAGAGAATTTTGGAGCTGGATATATAGGTGGAATTAGAATTGTGAAAATATCGTAATAA

SEQ ID NO: 1405 - protein, 633 aa, Bacillus thuringiensis
MNSVLNSRRTTICDAYNVVAHDPFSFEHKSLDTIQKEWMEWKRTDHSLYVAPVVGTVSSFLLKKVGSLIGKRILSELWGIIFPSGSTNLMQDILRETEQFLNQRLNTDTLARVNAELIGLQANIREFNQQVDNFLNPTQNPVPLSITSSVNTMQQLFLNRLPQFQIQGYQLLLLPLFAQAANMHLSFIRDVILNADEWGISAATLRTYRDYLRNYTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANENGTMIHLAPEDYTGFTISPIHATQVNNQTRTFISEKFGNQGDSLRFEQSNTTARYTLRGNGNSYNLYLRVSSIGNSTIRVTINGRVYTVSNVNTTTNNDGVNDNGARFSDINIGNIVASDNTNVTLDINVTLNSGTPFDLMNIMFVPTNLSPLY

SEQ ID NO: 1406 - protein, 633 aa, Bacillus thuringiensis; identical to SEQ ID NO: 266

SEQ ID NO: 1407 - protein, 633 aa, Bacillus thuringiensis serovar israelensis
MNTVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 1408 - protein, 633 aa, Bacillus thuringiensis
MNSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAASLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPLY

SEQ ID NO: 1409 - protein, 633 aa, Bacillus thuringiensis
MNSVLNIGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSPGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNIPPLY

SEQ ID NO: 1410 - protein, 633 aa, Bacillus thuringiensis
MNSVLNTGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 1411 - protein, 142 aa, Bacillus thuringiensis
MNNVLNSRRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAV

SEQ ID NO: 1412 - protein, 632 aa, Bacillus thuringiensis
MNTVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNLPPL

SEQ ID NO: 1413 - protein, 142 aa, Bacillus thuringiensis
MNTVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAV

SEQ ID NO: 1414 - protein, 633 aa, Bacillus thuringiensis
MNSVLNNGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQSQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNIPPLY

SEQ ID NO: 1415 - protein, 1902 aa, Bacillus thuringiensis
ATGAATAGTGTATTGAATAGCGGAAGAACTACTATTTGTGATGCGTATAATGTAGCGGCTCATGATCCATTTAGTTTTCAACACAAATCATTAGATACCGTACAAAAGGAATGGACGGAGTGGAAAAAAAATAATCATAGTTTATACCTAGATCCTATTGTTGGAACTGTGGCTAGTTTTCTGTTAAAGAAAGTGGGGAGTCTTGTTGGAAAAAGGATACTAAGTGAGTTACGGAATTTAATATTTCCTAGTGGTAGTACAAATCTAATGCAAGATATTTTAAGAGAGACAGAAAAATTCCTGAATCAAAGACTTAATACAGACACTGTTGCCCGTGTAAATGCGGAATTGACAGGGCTGCAAGCAAATGTAGAAGAGTTTAATCGACAAGTAGATAATTTTTTGAACCCTAACCGAAACGCTGTTCCTTTATCAATAACTTCTTCAGTTAATACAATGCAACAATTATTTCTAAATAGATTACCCCAGTTCCAGATGCAAGGATACCAACTGTTATTATTACCTTTATTTGCACAGGCAGCCAATTTACATCTTTCTTTTATTAGAGATGTTATTCTAAATGCAGATGAATGGGGAATTTCAGCAGCAACATTACGTACGTATCGAGATTACTTGAAAAATTATACAAGAGATTACTCTAACTATTGTATAAATACGTATCAAAGTGCGTTTAAAGGTTTAAACACTCGTTTACACGATATGTTAGAATTTAGAACATATATGTTTTTAAATGTATTTGAATATGTATCTATCTGGTCGTTGTTTAAATATCAAAGTCTTCTAGTATCTTCCGGTGCTAATTTATATGCAAGTGGTAGTGGACCACAGCAGACCCAATCATTTACTTCACAAGACTGGCCATTTTTATATTCTCTTTTCCAAGTTAATTCAAATTATGTGTTAAATGGATTTAGTGGTGCTAGGCTTTCTAATACCTTCCCTAATATAGTTGGTTTACCTGGTTCTACTACAACTCACGCATTGCTTGCTGCAAGGGTTAATTACAGTGGAGGAATTTCGTCTGGTGATATAGGTGCATCTCCGTTTAATCAAAATTTTAATTGTAGCACATTTCTCCCCCCATTGTTAACGCCATTTGTTAGGAGTTGGCTAGATTCAGGTTCAGATCGGGAGGGCGTTGCCACCGTTACAAATTGGCAAACAGAATCCTTTGAGACAACTTTAGGGTTAAGGAGTGGTGCTTTTACAGCTCGCGGTATTTCAAACTATTTCCCAGATTATTTTATTCGTAATATTTCTGGAGTTCCTTTAGTTGTTAGAAATGAAGATTTAAGAAGACCGTTACACTATAATGAAATAAGAAATATAGCAAGTCCTTCAGGAACACCTGGTGGAGCACGAGCTTATATGGTATCTGTGCATAACAGAAAAAATAATACCCATGCCGTTCATGAAAATGGTTCTATGATTCATTTAGCGCCAAATGACTATACAGGATTTACTATTTCGCCGATACATGCAACTCAAGTGAATAATCAAACACGAACATTTATTTCTGAAAAATTTGGAAATCAAGGTGATTCCTTAAGGTTTGAACAAAATAACACGACAGCTCGTTATACGCTTAGAGGGAATGGAAATAGTTACAATCTTTATTTAAGAGTTTCTTCAATAGGAAATTCCACTATTCGAGTTACTATAAACGGTAGGGTATATACTGCTACAAATGTTAATACTACTACAAATAACGATGGAGTTAATGATAACGGAGCTCGTTTTTCAGATATTAATATCGGTAATGTAGTAGCAAGTAGTAATTCTGATGTACCATTAGATATAAATGTAACATTAAACTCCGGTACTCAATTTGATCTTATGAATATTATGCTTGTACCAACTAATATTTCACCACTTTATTAA

SEQ ID NO: 1416 - protein, 633 aa, Bacillus thuringiensis
MNNVLNSGRNITCHAHNVVAHDPFSFEHKSLNTIEKEWKEWKRTDHSLYVAPIVGTVGSFLLKKVGSLVGKRILSELQNLIFPSGSIDLMQEILRATEQFINQRLNADTLGRVNAELAGLQANVAEFNRQVDNFLNPNQNPVPLAIIDSVNTLQQLFLSRLPQFQIQGYQLLLLPLFAQAANLHLSFIRDVILNADEWGISAATVRTYRDHLRNFTRDYSNYCINTYQTAFRGLNTRLHDMLEFRTYMFLNVFEYVSIWSLFKYQSLMVSSGANLYASGSGPQQTQSFTAQNWPFLYSLFQVNSNYILSGISGTRLSITFPNIGGLPGSTTTHSLNSARVNYSGGVSSGLIGATNLNHNFNCSTVLPPLSTPFVRSWLDSGTDREGVATSTNWQTESFQTTLSLRCGAFSARGNSNYFPDYFIRNISGVPLVIRNEDLTRPLHYNQIRNIESPSGTPGGARAYLVSVHNRKNNIYAANEYGTMIHLAPEDYTGFTISPIHATQVNNQTRTFISEKFGNQGDSLRFEQSNTTARYTLRGNGNSYNLYLRASSIGNSTIRVTINGRAYTVSNVNTTTNNDGVNDNGARFSDINIGNIVASDNTNVTLDINVTLNSGTPFDLMNIMFVPTNLPPLY

SEQ ID NO: 1417 - protein, 1152 aa, Bacillus thuringiensis
ATGTTAGATACTAATAAAGTTTATGAAATAAGTAATCATGCTAATGGACTATATGCAGCAACTTATTTAAGTTTAGATGATTCAGGTGTTAGTTTAATGAATAAAAATGATGATGATATTGATGATTATAACTTAAAATGGTTTTTATTTCCTATTGATGATGATCAATATATTATTACAAGCTATGCAGCAAATAATTGTAAAGTTTGGAATGTTAATAATGATAAAATAAATGTTTCGACTTATTCTTCAACAAATTCAATACAAAAATGGCAAATAAAAGCTAATGGTTCTTCATATGTAATACAAAGTGATAATGGAAAAGTCTTAACAGCAGGAACCGGTCAAGCTCTTGGATTGATACGTTTAACTGATGAATCCTCAAATAATCCCAATCAACAATGGAATTTAACTTCTGTACAAACAATTCAACTTCCACAAAAACCTATAATAGATACAAAATTAAAAGATTATCCCAAATATTCACCAACTGGAAATATAGATAATGGAACATCTCCTCAATTAATGGGATGGACATTAGTACCTTGTATTATGGTAAATGATCCAAATATAGATAAAAATACTCAAATTAAAACTACTCCATATTATATTTTAAAAAAATATCAATATTGGCAACGAGCAGTAGGAAGTAATGTAGCTTTACGTCCACATGAAAAAAAATCATATACTTATGAATGGGGAACAGAAATAGATCAAAAAACAACAATCATAAATACATTAGGATTTCAAATCAATATAGATTCAGGAATGAAATTTGATATACCAGAAGTAGGTGGAGGTACAGATGAAATAAAAACACAACTAAATGAAGAATTAAAAATAGAATATAGTCGTGAAACTAAAATAATGGAAAAATATCAAGAACAATCTGAAATAGATAATCCAACTGATCAACCAATGAATTCTATAGGATTTCTTACTATTACTTCTTTAGAATTATATAGATATAATGGCTCAGAAATTCGTATAATGCAAATTCAAACCTCAGATAATGATACTTATAATGTTACTTCTTATCCAGATCATCAACAAGCTTTATTACTTCTTACAAATCATTCATATGAAGAAGTAGAAGAAATAACAAATATTCCTAAAAGTACACTAAAAAAATTAAAAAAATATTATTTTTAA

SEQ ID NO: 1418 - protein, 1291 aa, Bacillus thuringiensis
GAAAGATCCAATTTTTTCACTTAATACTCTTCAGGAGTATGGACCAACTTTTTTGAGTATAGAAAACTCTATTCGAAAACCTCATTTATTTGATTATTTACAGGGGATTGAATTTCATACGCGTCTTCAACCTGGTTACTTTGGGAAAGATTCTTTCAATTATTGGTCTGGTAATTATGTAGAAACTAGACCTAGTATAGGATCTAGTAAGACAATTACTTCCCCATTTTATGGAGATAAATCTACTGAACCTGTACAAAAGCTAAGCTTTGATGGACAAAAAGTTTATCGAACTATAGCTAATACAGACGTAGCGGCTTGGCCGAATGGTAAGGTATATTTAGGTGTTACGAAAGTTGATTTTAGTCAATATGATGATCAAAAAAATGAAACTAGTACACAAACATATGATTCAAAAAGAAACAATGGCCATGTAAGTGCACAGGATTCTATTGACCAATTACCGCCAGAAACAACAGATGAACCACTTGAAAAAGCATATAGTCATCAGCTTAATTACGCGGAATGTTTCTTAATGCAGGACCGTCGTGGAACAATTCCATTTTTTACTTGGACACATAGAAGTGTAGACTTTTTTAATACAATTGATGCTGAAAAGATTACTCAACTTCCAGTAGTGAAAGCATATGCCTTGTCTTCAGGTGCTTCCATTATTGAAGGTCCAGGATTCACAGGAGGAAATTTACTATTCCTAAAAGAATCTAGTAATTCAATTGCTAAATTTAAAGTTACATTAAATTCAGCAGCCTTGTTACAACGATATCGTGTAAGAATACGCTATGCTTCTACCACTAACTTACGACTTTTTGTGCAAAATTCAAACAATGATTTTCTTGTCATCTACATTAATAAAACTATGAATAAAGATGATGATTTAACATATCAAACATTTGATCTCGCAACTACTAATTCTAATATGGGGTTCTCGGGTGATAAGAATGAACTTATAATAGGAGCAGAATCTTTCGTTTCTAATGAAAAAATCTATATAGATAAGATAGAATTTATCCCAGTACAATTGTAAGGAGATTTTAAAATGTTGGGTGATGGTCAAAATGAAAGAATAGGAAGGTGAATTTTGATGGTTAGGAAAGATTCTTTTAACAAAAGCAACATGGAAAAGTATACAGTACAAATATTAGAAATAAAATTTATTAACACAGGGGAAGATGGTAAACCAGAACCGTATGGTTATATTGACTTTTATTATCAACCTGCTCCTAACCTGAGAGAAGAAAAAGTAAGAATTTGGGAAGAGGAAAATAGTAGC

SEQ ID NO: 1419 - protein, 362 aa, Bacillus thuringiensis; identical to SEQ ID NO: 425

SEQ ID NO: 1420 - protein, 609 aa, Bacillus thuringiensis
MGTWWPTDSASDTWGEMIGFAQELVGTALSEDLKIRTNQQIDSIRIALQAYYSSLEDWLNANKPLSGPLLNQVTEEFGNALRKSRDSIAYFKSDDSNVYTIILLPAYAQVANFHLALIHEGLKYATEWNLPRLQTFGYEEDLKHYTISYVNHCEYWYQKGLDILYPRNVIGMTQWMKRNFYRLNMTINVLDIISLFSLYDSKKYPNFFEDIYNAQKELISKFQLTRIVTTEPTLHQHKYLNDSSKKICQNESSCDPIDLDEYLTLPLMFQNWLRNINFQYLAPVISVGDEALYPFFVATQNINEYMNAEGNMIIGRQQGLWNFQFIIVHLFHLVYKKMTIFMVKWLSAYPLIDEDILNGVRTPYILQKIEFYNLNKSINSKQIRPISAGTTKSPLIDIYYGLPDVNGYNLDEPQFNFNAASHYFNSIQTCYYKENTSKNHYDIYQSYVFHWEHASVKRKDEVVSDRITIFPAIKSNPILSRGIQIISHQGHTGGNVIYFTPQSELHFKINFVSNRQKYKIRLRYVAFNPVVIQYHGSNSYASLSSITLPRTSSNQNVRDLRYEEFGYSDFEINMSSAGGLEDIKIISNNEFILDRIEFIPDTLFNYLSN

SEQ ID NO: 1421 - protein, 837 aa, Bacillus thuringiensis
MKIYDIYPHYNVLSDAALITSYASDFRDSLKGLEEIWSKYATEGNRSAMTSYVSNIMQLYQTDSINYQALVKSAITLNLALTPLAPVSPFINMVIGFVRPFLFGSSKEVSMFDQIMDAVKKEMEHSFEQFTLNNLNDTINGLKTDLYDFTRLIDASTGVLQLPYESGEGCKPCKLGENSPCAPCYNDMIAINSKFQALTSSFNNALPHFKDPLANVIEKPNPGWNQEYITMCLPLYTLVATLELLTYQGYIQFAEKWRIPADSETSPITTTQIANMKANLRQRIQEHSNDIYTTFIKYLPKVNENATKGELNDYIRYHRVITLQCLDFVATWPFLDSRYYQSSGAATINFTRMTYLDIVGPVEDFYNDSKLDPSRDSGKLILSIKDINGKNDTNKISDVIAPLSLFYDNLELKSLKFNVYNSSWHCYINGYQGIYNSLSNDVSVSTNTNNLAKDLYLDFPLLNKLNMRSYAVGKASVDDSMVYVDDDSDVPSGNGHAIYGGCNGFYTGGPHSNNTLNYDNQIIQAIYEVTASNPNVYTYYYNADKTGYLATLSPIETTLSPIIGTDFQVINTVPAEQVISTSGTKFVEYITGSAVLELKPNQTAKYSILNQGLFQYKVRARVATTDSGSLSITMNNKTINLNIINTKNYTDPTTAFTNLKIQGKNGSYMVFPLSDAEHTTFDNVFNPNYGTVTMEVTNNSNTNIIIDRFEFIPYAPSKGTLLDTIPETIRTGGDSSILWKSTTGIGGQQVDLNIVIKDPSGIDVTTNYLLQYGSSYEFPLFSGQHSYPAVLNNEFTELGIDNCYGGNLGCNMNMPLKTIVPEGYTLTFSGNIYNNLK

SEQ ID NO: 1422 - protein, 1220 aa, Bacillus thuringiensis
MAILNELYPSVPYNVLAYTPPSFLPDAGTQATPADLTAYEQLLKNLEKGINAGTYSKAIADVLKGIFIDDTINYQTYVNIGLSLITLAVPEIGIFTPFIGLFFAALNKHDAPPPPNAKDIFEAMKPAIQEMIDRTLTADEQTFLNGEISGLQNLAARYQSTMDDIQSHGGFNKVDSGLIKKFTDEVLSLNSFYTDRLPVFITDNTADRTLLGLPYYAILASMHLMLLRDIITKGPTWDSKINFTPDAIDSFKTDIKNNIKLYSKTIYDVFQKGLASYGTPSDLESFAKKKKYIEIMTTHCLDFARLFPTFDPDLYPTGSGDISLQKTRRILSPFIPIRTADGLTLNNTSIDTSNWPNYENGNGAFPNPKERILKQFKLYPSWRAGQYGGLLQPYLWAIEVQDSVETRLYGQLPAVDPQAGPNYVSIDSSNPIIQINMDTWKTPPQGASGWNTNLMRGSVSGLSFLQRDGTRLSAGMGGGFADTIYSLPATHYLSYLYGTPYQTSDNYSGHVGALVGVSTPQEATLPNIIGQPDEQGNVSTMGFPFEKASYGGTVVKEWLNGANAMKLSPGQSIGIPITNVTKHNYQVRCRYASNSDNPVFFNVDTGGANPIFQQINFASTVDSNMGVKEENGVYVVKSIKTVEIPAGSFYVHVTNQGSSDLFLDRIEFVPKIQFQFCDNNNLHCDCNNPVDTDCTFCCVCTSLTDCDCNNPRGIDCTLCCQVENQLPSFVTLTDLRNITSQVNGLFAPGTQNRLAQNISDHDIEEVVLKVDALSDEIFGTNKKALRKLVNQAKRLSRARNLLIGGSFENWDAWYKGRNVVTVSDHELFKSDHVLLPPPGLSPSYIFQKVEESKLKANTRYTVSGFIAHATDLEIVVSRYGQEIKKVVQVPYGEAFPLTSSGPVCCIPHSTSNGTLGNPHFFSYSIDVGALDVDTNPGIEFGLRIVNPTGMARVSNLEIREDRPLAANEIRQVQRVARNWRTEYEKERAEVTSLIQPVINRINGLYENENWNGSIRSDISYQNIDAIVLPTLPTLRHWFMSDRFSEQGDIMAKFQGALNRAYAQLEQSTLLHNGHFTKDAANWTIEGDAHQITLEDGRRVLRLPDWSSSVSQMIEIENFNPDKEYNLVFHGQGEGTVTLEHGEETKYIETHTHHFANFTTSQRQGLTFESNKVTVTISSEDGEFLVDNIALVEAPLPTDDQNSEGNTAFSTNSDTSMNNNQ

SEQ ID NO: 1423 - protein, 3504 aa, Bacillus thuringiensis
ATGAGTCCAAATAATCAAAATGAATATGAAATTCTAGATGCTTCATCATCTACTTCTGTATCCGATAATTCTGTTAGATACCCTTTAGCAAACGATCAAACGACCACATTACAAAACATGAACTATAAAGATTATCTGAGAATGTCTGAGGGAGAGAATCCTGAATTATTTGGAAATCCGGAGACGTTTATTAGTTCATCTACGGTTCAAACTGGAATTGGCATTGTTGGTCAAGTACTGGGGGCTTTAGGGGTTCCATTTGCTGGACAGATAGCTAGTTTTTATAGTTTCATTGTCGGTCAATTATGGCCATCAAGTACCGTGAGTGTATGGGAAATGATTATGAAACAAGTGGAAGATCTAATTGATCAAAAAATAACAGATTCTGTAAGGAAAACAGCGCTTGCAGGACTACAAGGATTAGGAGATGGCTTAGACGTATATCAGAAATCACTTAAGAATTGGCTGGAAAATCGTAATGATACAAGAGCTAGAAGTGTTGTGGTGACCCAATATATAGCTTTAGAGCTTGATTTTGTTGCTAAAATCCCATCTTTTGCAATATCTGGACAGGAAGTACCATTATTATCAGTGTATGCACAAGCAGCGAATTTACATTTGCTATTATTACGAGATGCTTCCATTTTTGGAGCAGAGTGGGGATTCACACCAGGAGAAATTTCCACATTTTATGATCGTCAGGTGACACGTACCGCCCAATACTCGGATTATTGTGTAAAGTGGTATAACACTGGCTTAGATAAATTAAAAGGTACGAATGCTGCAAGTTGGCTGAAGTATCACCAATTCCGAAGAGAAATGACATTACTGGTATTAGATTTAGTAGCGTTATTTCCAAACTATGACACACGTACGTATCCAATCGAAACAACGGCCCAACTTACACGGGAAGTGTATACAGATCCAATAGTATTTAACAGAGAAACAAGTGGTGGATTTTGTAGGCGTTGGTCACTTAACAGTGATATTTCTTTTTCAGAAGTCGAAAGCGCTGTAATTCGTTCACCACACCTATTTGATATACTCAGTGAAATAGAATTTTATACAACAAGAGCGGGGCTTCCCTTGAATAATACGGAATACCTTGAATATTGGGTAGGACATTCTATAAAATATAAAAATACGAATGCCTCATCAGCATTAGAACGTAATTACGGTACGATTACTTCTAACAAAATCAAGTATTATGATTTAGCAAATAAGGATATCTTTCAGGTTCGATCATTAGGGGCGGATTTAGCTAATTACTACGCACAGGTATATGGAGTTCCGTACGCTAGTTTTACACTGCTTGACAAGAATACAGGATCAGGATCAGTTGGAGGTTTTACGTACTCAAAACCACATACAACTATGCAAGTATGTACACAAAATTACAATACGATTGATGAAATCCCTCCAGAGAATGAGCCACTTAGTAGAGGGTATAGCCATAGATTATCTCATATCACCTCTTATTCTTTTTCTAAGAATGCTAGTAGTCCTGCTAGATATGGCAATCTCCCTGTATTTGCTTGGACACATCGGAGTGCGGATGTTACAAATACAGTTTATTCAGATAAAATTACTCAGATACCAGTTGTAAAGGCACATACTTTAGTTTCAGGTACTACTGTTATTAAAGGTCCTGGATTTACAGGAGGCAATATCCTTAAAAGAACAAGTAGTGGTCCGTTAGCTTATACTAGTGTCTCTGTAAAATCACCATTATCACAAAGATATCGTGCAAGAATACGTTATGCTTCTACTACTAACTTACGACTTTTTGTAACAATTTCTGGAACTCGCATTTACTCTATAAATGTTAATAAAACCATGAATAAAGGGGATGATTTAACATTTAATACATTTGACTTAGCAACTATTGGTACTGCTTTCACATTTTCAAATTACTCGGATAGCTTAACGGTAGGTGCAGATTCTTTTGCTTCAGGAGGAGAAGTTTATGTAGATAAGTTCGAACTTATTCCGGTAAATGCAACATTTGAAGCAGAAGAAGACCTAGATGTGGCAAAGAAAGCAGTAAATGGCTTGTTTACGAGTAAAAAAGATGCCTTACAGACAAGTGTAACGGATTATCAAGTGAATCAAGCGGCAAACTTAGTAGAATGCCTATCCGATGAGTTATACCCAAATGAAAAACGAATGTTATGGGATGCAGTGAAAGAGGCGAAACGACTTGTTCAGGCACGTAACTTACTCCAAGATACAGGCTTTAATAGGATTAATGGAGAAAACGGATGGACGGGAAGTACGGGAATCGAGGTTGCGGAAGGAGATGTTCTGTTTAAAGATCGTTCGCTTCGTTTGACAAGTGCGAGAGAGATTGATACAGAAACATATCCAACGTATCTCTATCAACAAATAGATGAATCACTTTTAAAACCATATACAAGATATAAACTAAAAGGTTTTATAGGAAGTAGTCAAGATTTAGAGATTAAATTAATACGTCATCGGGCAAATCAAATCGTCAAAAATGTACCAGATAATCTCTTGCCAGATGTACTCCCTGTCAATTCTTGTGGTGGGATCGATCGCTGCAGTGAGCAACAGTATGTAGACGCGAATTTAGCACTCGAAAACAATGGAGAAAATGGAAATATGTCTTCTGATTCCCATGCATTTTCTTTCCATATTGATACAGGTGAAATAGATTTGAATGAAAATACAGGAATTTGGGTCGTATTTAAAATTCCGACAACAAATGGATACGCAACACTAGGAAATCTTGAATTGGTAGAAGAGGGGCCATTGTCAGGGGAAACATTAGAACGAGCACAACAACAAGAACAACAATGGCAAGACAAAATGGCAAGAAAACGTGGGGCATCAGAAAAAGCATATTATGCAGCAAAGCAAGCCATTGATCGTTTATTCGCAGATTATCAAGACCAAAAACTTAATTCTGGTGTAGAAATGTCAGATATGTTGGCAGCCCAAAACCTTGTACAGTCCATTCCTTACGTATATAATGATGCGTTACCAGAAATCCCTGGAATGAACTATACGAGTTTTACAGAGTTAACAAATAGACTCCAACAAGCATGGAATTTGTATGATCTTCGAAATGCTATACCAAATGGAGATTTTCGAAATGGATTAAGTGATTGGAATGCAACATCAGATGTGAATGTGCAACAACTAAGCGATACATCTGTCCTTGTCATTCCAAACTGGAATTCTCAAGTGTCACAACAATTTACAGTTCAACCGAATTATAGATATGTGTTACGTGTCACAGCGAGAAAAGAGGGAGTAGGAGACGGATATGTGATCATCCGTGATGGTGCGAATCAGACAGAAACACTCACATTTAATATATGTGATGATGATACAGGTGTTTTATCTGCTGATCAAACTAGCTATATCACAAAAACAGTGGAATTCACTCCATCTACAGAGCAAGTTTGGATTGACATGAGTGAGACCGAAGGTGTATTCAACATAGAAAGTGTAGAACTCGTGTTAGAAGAAGAGTAA

SEQ ID NO: 1424 - protein, 144 aa, Bacillus thuringiensis
MEGGNNQGFINIEGRLSLEQVLAVSAGVASYILSNLGPFGVFFSYIIGAFWPTAPSDTRVWEAFMELIEARIDQKIQESTRKDAIARLQGLGAASEVYQESLESWLENQNDARAMSVVRQQFVAFELDFVTAMPFFERSGDEIL

SEQ ID NO: 1425 - protein, 1154 aa, Bacillus thuringiensis
MNRNNQNEYEIIDGTNCGCSSDEVVKYPLTDDPNAGLQNMNYKEYLQTYDGDYTGSLINPNLSINTRDVLQTGINIVGRVLGFLGVPFAGQLVTFYTFLLNQLWPTNNNAVWEAFMAQIEELIDQRISEQVVRNALDALTGIHDYYNEYLAALEEWLERPNGARANLAFQRFENLHQLFVSQMPSFGSGPGSERDAVALLTVYAQAANLHLLLLKDAEIYGARWGLNQGQINLYFNAQQDRTQIYTNHCVATYNRGLENLRGTNTESWYNYHQFRREMTLMAMDLVALFPYYNLRQYPNGANPQLTREIYTDPVVFNPPANQGLCRRWRNNPYMTFSELENTFIRPPHLFDRLNSLTINSHRFPISSNFMDYWAGHTLRRSYMNNSAVQEDSYGATTSTRVTINTGVNGTNRIESTAVDFRSGLLGVYGVHRASFVPGGLFNGTISPANAGCRNLHDTRDELPLEENNGSPSHRLSHVTFLSFLTDQAGSIRNSGAVPLYVWARQDIDLNNTITANRITQLPLVKASEIAAGTTVVRGPGFTGGDILRRTSAGTLGTIRVNVNSPLTQRYRVRFRYASTTDFNFFVIRGGTTVNNFTFPRTMNSGQESRYESYVTREFSTSFNFLQIQDTLRLTVQSFSSGQQVYVDRIEIIPVNPTREAEEDLEAAKKAVANLFTHTRDGLQVNVTDYQVDQAANLVSCLSDEQYSHDKKMLLEAVRAAKRLSRERNLLQDPDFNEINTIEENGWKASNGVTISEGGPFFKGRALQLASARENNPTYIYQKVDASVLKPYTRYRLDGFVASSQDLELDLIHQHKVHLVKNVPDNLVSDSYSDGSCSGINRCEEQHLVDMQLDAEHHPMDCCEAAETHEFSSYIDTGDLNPSVDQGIWVVLKVRTTDGYATLGNLELVEVGPLSGESLEREQKDNAKWNAELGRKRAETDRVYQAAKQAINHLFVDYQDQQLNPEIGLAEMNEASNLLESIPGVYSDTVLQIPGVNYEIYTELSNRLQQASYLFMSRNAVQNGDFNNGLDSWNATTDATVQQDGTMHFLVLSHWDAQVSQPLRVQPNCKYVLRVTARKVGGGDGYVTIQDGAHHQETLTFNACDYDVNGTYVNDNTYITKEVVFYPETKHMWIEVSESEGAFYIDSIEFIEIQE

SEQ ID NO: 1426 - protein, 638 aa, Bacillus thuringiensis
EIIDGTNCGCSSDEVVKYPLTDDPNAGLQNMNYKEYLQTYDGDYTGSLINPNLSINTRDVLQTGINIVGRVLGFLGVPFAGQLVTFYTFLLNQLWPTNNNAVWEAFMAQIEELIDQRISEQVVRNALDALTGIHDYYNEYLAALEEWLERPNGARANLAFQRFENLHQLFVSQMPSFGSGPGSERDAVALLTVYAQAANLHLLLLKDAEIYGARWGLNQGQINLYFNAQQDRTQIYTNHCVATYNRGLENLRGTNTESWYNYHQFRREMTLMAMDLVALFPYYNLRQYPNGANPQLTREIYTDPVVFNPPANQGLCRRWRNNPYMTFSELENTFIRPPHLFDRLNSLTINSHRFPISSNFMDYWAGHTLRRSYMNNSAVQEDSYGATTSTRVTINTGVNGTNRIESTAVDFRSGLLGVYGVHRASFVPGGLFNGTISPANAGCRNLHDTRDELPLEENNGSPSHRLSHVTFLSFLTDQAGSIRNSGAVPLYVWARQDIDLNNTITANRITQLPLVKASEIAAGTTVVRGPGFTGGDILRRTSAGTLGTIRVNVNSPLTQRYRVRFRYASTTDFNFFVIRGGTTVNNFTFPRTMNSGQESRYESYVTREFSTSFNFLQIQDTLRLTVQSFSSGQQVYVD

SEQ ID NO: 1427 - protein, 249 aa, Bacillus thuringiensis
MENLNHCPLEDIKVNPWKTPQSTARVITLRVEDPNEINNLLSINEIDNPNYILQAIMLANAFQNALVPTSTDFGDALRFSMAKGLEIANTITPMGAVVSYVDQNVTQTNNQVSVMINKVLEVLKTVLGVALSGSVIDQLTAAVTNTFTNLNTQKNEAWIFWGKETANQTNYTYNVLFAIQNAQTGGVMYCVPVGFEIKVSAVKEQVLFFTIQDSASYNVNIQSLKFAQPLVSSSQYPIADLTSAINGTL

SEQ ID NO: 1428 - protein, 249 aa, Bacillus thuringiensis; identical to SEQ ID NO: 1427

SEQ ID NO: 1429 - protein, 249 aa, Bacillus thuringiensis; identical to SEQ ID NO: 520

SEQ ID NO: 1430 - protein, 250 aa, Bacillus thuringiensis
MENPNHCPLEDIQVNPWKTPQSKARVITLRIDDPNEINNLLSINEIENTNYLLQAIMLANAFQKALVPTSTEFAEDALQFSMTKGLEVANTISPPGAVVQYVDQNVSQTNNQVSAMINKVLDVLKSILGVALGQSVIEQLTSAVTNTFTNLNTQKNEAWIFWGRETSTQTNYTYNVLFAIQNGQTGGVMYCVPVGFEIKVSAVKERVLFLTIQDSASYNVNIQSLKFAQPLVSASEYPIADLTSAINGTL

SEQ ID NO: 1431 - protein, 265 aa, Bacillus thuringiensis
MKESIYYNEENEIQISQGNCFPEELGHNPWRQPQSTARVIYLKVKDPIDTTQLLEITEIENPNYVLQAIQLAAAFQDALVPTETEFGEAIRFSMPKGLEVAKTIQPKGAVVAYTDQTLSQSNNQVSVMIDRVISVLKTVMGVALSGSIITQLTAAITDTFTNLNTQKDSAWVFWGKETSHQTNYTYNVMFAIQNETTGRVMMCVPIGFEIRVFTDKRTVLFLTTKDYANYSVNIQTLRFAQPLIDSRALSINDLSEALRSSKYLY

SEQ ID NO: 1432 - protein, 525 aa, Bacillus thuringiensis
MAQSEFNQNLREQGQSRARVIILRVNNPGYNTNTLDIADIEDIIHLPQAIELANAFQSALVPTTSNFGEDTLRFDVERGLGIATHVYPRAINVNYVTRTLSQTNNQVQSMINKVIEELKSLLGINLANSVLQQLTTVITETFTNLYVQQQSAWLFWGRQTSSQTNYTYNIVFAIQNAQTGSFMKAIPIGFEISAYIARERLLFFNIQDYASYSVKIHAIQVMQPLIHESFQPLRGIFNIITSVNNRSAIQITEYYDENTHDYPVKLWDYNNIINQKWILVFNQTTRAYSIQNLIARYLVLTWDSTPGSNKVFASTNRWNDSQFWILESTADGSIFLTNMKDTQFVLEIENSSTTNGTNVIVNRKNNNAQQKFYLNKVNQEFQDGVYKIKTALNNSSVLQMSEDYFGYTSDYFVKLWTNNNNDINQKWIFEFDSTKSAYQIKSQRDPSLVLAWTWSVPTVKLPIPNNDDHLWFLQNAGSGTYYFVNMTDTRYVLEVASSSTTNGTILTINKRNGNLNQKFLLDMIN

SEQ ID NO: 1433 - protein, 259 aa, Bacillus thuringiensis
MYTKNFSNSRMEVKGNNGCSAPIIRKPFKHIVLTVPSSDLDNFNTVFYVQPQYINQALHLANAFQGAIDPLNLNFNFEKALQIANGIPNSAIVKTLNQSVIQQTVEISVMVEQLKKIIQEVLGLVINSTSFWNSVEATIKGTFTNLDTQIDEAWIFWHSLSAHNTSYYYNILFSIQNEDTGAVMAVLPLAFEVSVDVEKQKVLFFTIKDSARYEVKMKALTLVQALHSSNAPIVDIFNVNNYNLYHSNHKIIQNLNLSN

SEQ ID NO: 1434 - protein, 259 aa, Bacillus thuringiensis; identical to SEQ ID NO: 1433

SEQ ID NO: 1435 - protein, 259 aa, Bacillus thuringiensis
MYTKNFSNSRMEVKGNNGCSAPIIRKPFKHIVLTVPSSDLDNFNTVFYVQPQYINQALHLANAFQGAIDPLNLNFNFEKALQIANGIPNSAIVKTLNQSVIQQTVEISVMVEQLKKIIQEVLGLVINSTSFWNSVEATIKGTFTNLDTQIDEAWIFWHSLSAHNTSYYYNILFSIQNEDTGAVMAVLPLAFEVSVDVEKQKVLFFTIKDSARYEVKMKALTLVQALHSSDAPIVDIFNVNNYNLYHSNHKIIQNLNLSN

SEQ ID NO: 1436 - protein, 259 aa, Bacillus thuringiensis; identical to SEQ ID NO: 1433

SEQ ID NO: 1437 - protein, 263 aa, Bacillus thuringiensis
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 1438 - protein, 263 aa, Bacillus thuringiensis; identical to SEQ ID NO: 1437

SEQ ID NO: 1439 - protein, 263 aa, Bacillus thuringiensis; identical to SEQ ID NO: 1437

SEQ ID NO: 1440 - protein, 263 aa, Bacillus thuringiensis; identical to SEQ ID NO: 1437

SEQ ID NO: 1441 - protein, 246 aa, Bacillus thuringiensis
YHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNLEPQVDENWIVWRNLSATQTSYFYKILFSIQNEDTGRFMAILPIAFEITVDVQKQQLLFITIKDSARYEVKMKALTVVQALDSYNAPIIDVFNVRNYSLHRPNHNILQNLNVNPIKS

SEQ ID NO: 1442 - protein, 156 aa, Bacillus thuringiensis
NTFQGAIDPLTLNFNFEKALQIANGLPNAGVTGTINQSVIHQTIEVSVMISQIKEIIRSVLGLVINSANFWNSVVSAITNTFTNLEPQVDENWVVWRNLSATQTSYFYKILFSIQNEDTGRFMAILPIAFEITVDVQKQQLLFITIKDSARYEVKM

SEQ ID NO: 1443 - protein, 157 aa, Bacillus thuringiensis; identical to SEQ ID NO: 528

SEQ ID NO: 1444 - protein, 147 aa, Bacillus thuringiensis
MHLNNLNNFNNLENNGEYHCSGPIIKKPFRHIALTVPSSDITNFNEIFYVEPQYIAQAIRLTNTFQGAIDPLTLNFNFEKALQIANGLPNAGVTGTINQSVIHQTIEVSVMISQIKEIIRSVLGLVINSANFWNSVVSAITNTFTNL

SEQ ID NO: 1445 - protein, 263 aa, Bacillus thuringiensis; identical to SEQ ID NO: 1437

SEQ ID NO: 1446 - protein, 263 aa, Bacillus thuringiensis
MYTKNLNSLEINEDYQYSRPIIKKPFRHITLTVPSSDIASFNEIFYLEPQYVAQALRLTNTFQAAIDPLTLNFDFEKALQIANGLPNAGITGTLNQSVIQQTIEISVMISQIKEIIRNVLGLVINSTNFWNSVLAAITNTFTNLEPQVDENWIVWRNLSATHTSYYYKILFSIQNEDTGAFMAVLPIAFEITVDVQKQQLLFITIRDSARYEVKMKALTVVQLLDSYNAPIIDVFNVHNYGLYQSNHPNHHILQNLNLNKIKG

SEQ ID NO: 1447 - protein, 880 aa, Bacillus thuringiensis
MKNMKKKLASVVTCTLLAPMFLNGNVNAVYADSKTNQISTTQKNQQKEMDRKGLLGYYFKGKDFSNLTMFAPTRDSTLIYDQQTANKLLDKKQQEYQSIRWIGLIQSKETGDFTFNLSEDEQAIIEINGKIISNKGKEKQVVHLEKGKLVPIKIEYQSDTKFNIDSKTFKELKLFKIDSQNQPQQVQQDELRNPEFNKKESQEFLAKPSKINLFTQKMKREIDEDTDTDGDSIPDLWEENGYTIQNRIAVKWDDSLASKGYTKFVSNPLESHTVGDPYTDYEKAARDLDLSNAKETFNPLVAAFPSVNVSMEKVILSPNENLSNSVESHSSTNWSYTNTEGASVEAGIGPKGISFGVSVNYQHSETVAQEWGTSTGNTSQFNTASAGYLNANVRYNNVGTGAIYDVKPTTSFVLNNDTIATITAKSNSTALNISPGESYPKKGQNGIAITSMDDFNSHPITLNKKQVDNLLNNKPMMLETNQTDGVYKIKDTHGNIVTGGEWNGVIQQIKAKTASIIVDDGERVAEKRVAAKDYENPEDKTPSLTLKDALKLSYPDEIKEIEGLLYYKNKPIYESSVMTYLDENTAKEVTKQLNDTTGKFKDVSHLYDVKLTPKMNVTIKLSILYDNAESNDNSIGKWTNTNIVSGGNNGKKQYSSNNPDANLTLNTDAQEKLNKNRDYYISLYMKSEKNTQCEITIDGEIYPITTKTVNVNKDNYKRLDIIAHNIKSNPISSLHIKTNDEITLFWDDISITDVASIKPENLTDSEIKQIYSRYGIKLEDGILIDKKGGIHYGEFINEASFNIEPLQNYVTKYEVTYSSELGPNVSDTLESDKIYKDGTIKFDFTKYSKNEQGLFYDSGLNWDFKINAITYDGKEMNVFH

SEQ ID NO: 1448 - protein, 881 aa, Bacillus thuringiensis serovar entomocidus
  MISC_FEATURE (846)..(846): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MKKKLASVVTCTLLAPMFLNGNVNAVYADSKTNQISTTQKNQQKEMDRKGLLGYYFKGKDFSNLTMFAPTRDSTLIYDQQTANKLLDKKQQEYQSIRWIGLIQSKETGDFTFNLSEDEQAIIEINGKIISNKGKEKQVVHLEKGKLVPIKIEYQSDTKFNIDSKTFKELKLFKIDSQNQPQQVQQDELRNPEFNKKESQEFLAKPSKINLFTQKMKREIDEDTDTDGDSIPDLWEENGYTIQNRIAVKWDDSLASKGYTKFVSNPLESHTVGDPYTDYEKAARDLDLSNAKETFNPLVAAFPSVNVSMEKVILSPNENLSNSVESHSSTNWSYTNTEGASVEAGIGPKGISFGVSVNYQHSETVAQEWGTSTGNTSQFNTASAGYLNANVRYNNVGTGAIYDVKPTTSFVLNNDTIATITAKSNSTALNISPGESYPKKGQNGIAITSMDDFNSHPITLNKKQVDNLLNNKPMMLETNQTDGVYKIKDTHGNIVTGGEWNGVIQQIKAKTASIIVDDGERVAEKRVAAKDYENPEDKTPSLTLKDALKLSYPDEIKEIEGLLYYKNKPIYESSVMTYLDENTAKEVTKQLNDTTGKFKDVSHLYDVKLTPKMNVTIKLSILYDNAESNDNSIGKWTNTNIVSGGNNGKKQYSSNNPDANLTLNTDAQEKLNKNRDYYISLYMKSEKNTQCEITIDGEIYPITTKTVNVNKDNYKRLDIIAHNIKSNPISSIHIKTNDEITLFWDDISITDVASIKPENLTDSEIKQIYSRYGIKLEDGILIDKKGGIHYGEFINEASFNIEPLQNYVTKYKVTYSSELGQNVSDTLESDKIYKDGTIKFDFTKYSXNEQGLFYDSGLNWDFKINAITYDGKEMNVFHRYNK

SEQ ID NO: 1449 - protein, 881 aa, Bacillus thuringiensis; identical to SEQ ID NO: 1448
  MISC_FEATURE (846)..(846): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.

SEQ ID NO: 1450 - protein, 834 aa, Bacillus thuringiensis tenebrionis
MKNMKKKLASVVTCMLLAPMFLNGNVNAVNADSKINQISTTQENQQKEMDRKGLLGYYFKGKDFNNLTMFAPTRDNTLMYDQQTANALLDKKQQEYQSIRWIGLIQRKETGDFTFNLSKDEQAIIEIDGKIISNKGKEKQVVHLEKEKLVPIKIEYQSDTKFNIDSKTFKELKLFKIDSQNQSQQVQLRNPEFNKKESQEFLAKASKTNLFKQKMKRDIDEDTDTDGDSIPDLWEENGYTIQNKVAVKWDDSLASKGYTKFVSNPLDSHTVGDPYTDYEKAARDLDLSNAKETFNPLVAAFPSVNVSMEKVILSPNENLSNSVESHSSTNWSYTNTEGASIEAGGGPLGLSFGVSVTYQHSETVAQEWGTSTGNTSQFNTASAGYLNANVRYNNVGTGAIYDVKPTTSFVLNNNTIATITAKSNSTALRISPGDSYPEIGENAIAITSMDDFNSHPITLNKQQVNQLINNKPIMLETDQTDGVYKIRDTHGNIVTGGEWNGVTQQIKAKTASIIVDDGKQVAEKRVAAKDYGHPEDKTPPLTLKDTLKLSYPDEIKETNGLLYYDDKPIYESSVMTYLDENTAKEVKKQINDTTGKFKDVNHLYDVKLTPKMNFTIKMASLYDGAENNHNSLGTWYLTYNVAGGNTGKRQYRSAHSCAHVALSSEAKKKLNQNANYYLSMYMKADSTTEPTIEVAGEKSAITSKKVKLNNQNYQRVDILVKNSERNPMDKIYIRGNGTTNVYGDDVTIPEVSAINPASLSDEEIQEIFKDSTIEYGNPSFVADAVTFKNIKPLQNYVKEYEIYHKSHRYEKKTVFDIMGVHYEYSIAREQKKAA

SEQ ID NO: 1451 - protein, 769 aa, Bacillus cereus
MKNMKKKLASVVTCTLLAPMFFNGNVNTAYADNKINQDSSKQEYQQKEMDRKGLLGYYFKDKDFSNLTMFSPTRYNTLIYDQQTANKLLDKKQQEYQSIRWIGLIQSNKTGDFTFELSDDECAIIEMDGKVISNKGKEKQVVHLEKGKLVPIKIEYQLDEPLNIDDEKFKGFKLLKVDNQKQLHQVQQDELRNPEFNKKESQEFLAKASKINLFTKKIKRDIDEGTDTDGDSIPDMWEENGYTIQNRIAVKWNDSLASKGYTKFVSNPLDSHTVGDPYTDYEKASRDLDLSNAKETFNPLVAAFPSVNVSMEKVILSPNKNLSNSVESHSSTNWSYTNTEGASVEAGIGPKGFSFGVSANYQHSETVAQEWGASIGDTTQLNTASAGYLNANVRYNNVGTGAIYDVKPTTSFVLEKNTIATITAKSNSTALSISPGESYPKKGQNGIAITSMDDFNSHPITLNKKQLDQVLTNNPIMLETDQTDGIYKIKDTHGNIVTGGTWNGVTQQIKAKTASIIVDDGKQVAEKRVAAKDYAYPEDKTPSLTLKDALKLSFPEEIKETDGLLYYNNKPIYESSVMTYLDGNTAKEVKKQINDKTGEFKDVQHLYAVKLTPKMNFTIKVPVAYDTAKQAVNLGGDNPWGAKGLLGTWVNAMVVDNSGDKAYKRVEPGYLLSPTLEFSEGSLDNLKKNYSFYVSMYVKSDKPFTLRINAGPYSTKRTIEASNDFKRVDIPAFYIEGFPIDTIRLEGSDYPSAIWWKDVSITEVSAVKK

SEQ ID NO: 1452 - protein, 784 aa, Bacillus laterosporus
MTYMKKKLVSVVTCTLLAPMFLNGNVNPVYADNQTNQLSTAQENQEKEVDRKGLLGYYFKGKEFNHLTLFAPTRDNTLIYDQQTVDSLLDKKQQEYQSIRWIGLIQSKETGDFTFNLSDDKNAIMEIDTKTISHKGQNKQVVHLEKGKLVPIKIEYQPDQIVNRDSKIFKEFKLFKVDSKQQSHQVQLDELRNPEFNKKETQQFLEKASKTNLFTQNMKRDEDATDTDGDSIPDLWEENGYTIQNKVAVKWDDSFAAKGYTKFVSNPFDSHTVGDPYTDYEKAARDLDLANAKETFNPLVAAFPSVNVNLEKVILSPNEDLSNSVESHSSTNWSYTNTEGVSIEAGSGPLGISYGVSANYQHSETVAKEWGTSTGNTSQFNTASAGYLNANVRYNNVGTGAIYEVKPTTGFVLDNDTVATITAKSNSTALSISPGESYPKKGQNGIAINTMDDFNSHPITLNKQQLDQIFNNKPLMLETNQADGVYKIKDTSGNIVTGGEWNGVIQQIQAKTASIIVDTGEGVSEKRVAAKDYDNPEDKTPSLSLKEALKLGYPEEIKEKDGLLYYNDKPIYESSVMTYLDENTAKEVKEQLNDITGKFKDVKQLFDVKLTPKMNFTIKLATLYDGAEDGSSPTDVGISSPLGEWAFKPDINNVEGGNTGKRQYQLSKNKDGYYYGMLALSPEVSNKLKKNYQYYISMSIKADAGVEPTVTVMDNLNCIVDKKLKLSSNGYQRFDILVDNSESHPINVMVIDLGVSSQDYNNYSKNIYIDDITITEVSAMKVKN

SEQ ID NO: 1453 - protein, 785 aa, Brevibacillus laterosporus
MTYMKKKLVSVVTCALLAPMFLNGNVNPVYADNQTNQLSTAQENQEKEVDRKGLLGYYFKGKEFNHLTLFAPTRDNTLIYDQQTVDFLLDKKQQEYQSIRWIGLIQSKETGDFTFNLSDDKNAIIEIDGKTISHKGQNKQVVHLEKGKLVPIKIEYQSDQIVNRDSKIFKEFKLFKVDSQQQSHQVQLDELRNPEFNKKETQQFLEKASKTNIFTQNMKRDEDATDTDGDSIPDLWEENGYTIQNKVAVKWDDSFAAKGYTKFVSNPFDSHTVGDPYTDYEKAARDLDLANAKETFNPLVAAFPSVNVNLEKVILSPNEDLSNSVESHSSTNWSYTNTEGASIEAGSGPLGISYGVSANYQHSETVAKEWGTSTGNTSQFNTASAGYLNANVRYNNVGTGAIYEVKPTTGFVLDNDTVATITAKSNSTALSISPGESYPKKGQNGIAINTMDDFNSHPITLNKQQLDQIFNNKPLMLETNQADGVYKIKDTSGNIVTGGEWNGVIQQIQAKTASIIVDTGEGVSEKRVAAKDYDNPEDKTPSLSLKEALKLGYPEEIKEKDGLLYYNDKPIYESSVMTYLDENTAKEVKEQLNDITGKFKDVKQLFDVKLTPKMNFTIKLATLYDGAEDGSSPTDVGISSPLGEWAFKPDINNVEGGNTGKRQYQLSKNKDGYYYGMLALSPEVSNKLKKNYQYYISMSIKADAGVEPTVTVMDNLLNGIVDKKLKLSSNGYQRFDILVDNSESHPINVMVIDLGVSSQDYNNYSKNIYIDDITITEVSAMKVKN

SEQ ID NO: 1454 - protein, 860 aa, Bacillus thuringiensis
MTYMKKKLVSVVTCTLLAPIFLTGNVHPVNADSKKSQPSTAQEKQEKPVDRKGLLGYFFKGKEFNHLTLFAPTRDNTLIYDQQTANSLLDTKQQEYQSIRWIGLIQSKETGDFTFNLSDDQNAIIEIDGKIISHKGQNKQVVHLEKGKLVPIKIEYQSDQILTRDSNIFKEFQLFKVDSQQHSHQVQLDELRNPDFNKKETQQFLEKAAKTNLFTQNMKRDTDDDDDTDTDGDSIPDLWEENGYTIQNKVAVKWDDSFAAKGYTKFVSNPLESHTVGDPYTDYEKAARDLDLANAKETFNPLVAAFPSVNVNLEKVILSPDENLSNSVESHSSTNWSYTNTEGASIEAGGGPLGISFGVSANYQHSETVAKEWGTSTGNTSQFNTASAGYLNANVRYNNVGTGAIYEVKPTTSFVLDKDTVATITAKSNSTALSISPGESYPKKGQNGIAINTMDDFNSHPITLNKQQLDQLLNNKPLMLETNQADGVYKIKDTSGNIVTGGEWNGVIQQIQAKTASIIVDTGESVSEKRVAAKDYDNPEDKTPSLSLKEALKLGYPEEIKEKDGLLYYKDKPIYESSVMTYLDENTAKEVEKQLQDTTGIYKDINHLYDVKLTPTMNFTIKLASLYDGAENNDVKNGPIGHWYYTYNTGGGNTGKHQYRSANPSANVVLSSEAKSKLDKNTNYYLSMYMKAESDTEPTIEVSGENSTITSKKVKLNSEGYQRVDILVPNSERNPINQIYVRGNNTTNVYWDDVSITNISAINPKTLTDEEIKEIYKDFSESKDWPWFNDVTFKNIKPLENYVKQYRVDFWNTNSDRSFNRIKDSYPVNEDGSVKVNMTEYNEGYPLRIESAYHLNISDL

SEQ ID NO: 1455 - protein, 860 aa, Bacillus thuringiensis; identical to SEQ ID NO: 1454

SEQ ID NO: 1456 - protein, 775 aa, Bacillus thuringiensis serovar israelensis
MKNMKKKLASVVTCTLLAPMFLNGNVNAVYADSKTNQISTTQKNQQKEMDRKGLLGYYFKGKDFSNLTMFAPTRDNTLIYDQQTANKLLDKKQQQYQSIRWIGLIQSKEKGDFTFNLSEDEQAIIEIDGKIISNKGKEKQVVHLEKEKLVPIKIEYQSDTKFNIDSKTFKEFKLFKIDSQNQSQQVKRDELRNPEFNKKESREFLAKASKTNFFMQKMKRDIDEDTDTDGDSIPDLWEENGYTIQNKVAVKWDDKFAQQGYVKYLSSPYQAHTVGDPYTDWEKAAGDIPKSNAAATRNPLVAAFPSINVDMRKMILSKDSNLSNSAEAHSNNSYTYANSEGASIEAGFGPKGFSFGVSANYQHTETVGSDWGNSKSNTEQFNSASAGYLNANVHYNNVGTGGIYDAQPTTSFILQDSTIATITAKSNATALSIPSGDRYPASKEGISLKTMDDFNSHPITLNKPQLDAVLNNEVIKINTDQTDGRYGIIGVDGKAEIGDRWSPIIDEIKGRTASIIIDPADGKALETRIAAKDYKNPEDKTPSLTIKEGLKIAYPESISEDKDGILFYEYKNDEGKVTKKQLSEENIMPYLDEDTSKEFERQLSDGSAKGLYDIKLTPKMNITIRLATVTLGFDDQFSAYPWENATWSDKFGNLRLGSLAIPQESKYTIPKDKVKPNYDYLITGYIKHDFTTDNESLGIVAFTKKDNFEMWNMGTSIFSQNSGGEFKKFTIKTQNISGDYILDSIQLMKRNNDVNKIDSYLDDISIIPIGPNKSR

SEQ ID NO: 1457 - protein, 871 aa, Brevibacillus laterosporus
MKYMKKGLSSVVIGTLFASMFLNGNVNAVYANSKTNQIATTTQASKDNQIDREGLLGYYFKGKDFNDLTLFAPTRDNTLIYDQQTANTLVDQKHQEYHSIRWIGLIQSSATGDFTFKLSDDENAIIELDGKVISEKGNNKQSVHLEKGQLVQIKIEYQSDDALHIDNKIFKELKLFKIDSQNHSQQVQQDELRNPEFNKKETQVFLKKASKTNLFTQKTKRDIDEDTDTDGDSIPDVWEENGYTIQNKVAVKWDDSLASKGYQKFTSNPLEAHTVGDPYSDYEKAARDMPLSNAKETFNPLVAAFPSVNVSLEKVILSKNEDLSHSVESSQSTNWSYTNTEGVNVNAGWSGLGPSFGVSVNYQHSETVANEWGSATNDGTHINGAESAYLNANVRYNNVGTGAIYETKPTTSFILDGTTIGTIKAKENTTALTILPDQSYPEKGKNGIAINTMDDFNSRPIPLNKEQLNTYLSNKKPILLETDQVEGKYAIKDTNGNITIAGDWNGITDEISAKTASIIVDNGNQMSEKRVAAKDYTNPEDKTPNLSVKEALKLAYPDEIEEKDGLLFYNDQPIFEASVQSYVDEYTAKQIRKQLNDSTGSFKDVKNLYDVKLEPKMNFTIKTSTLYDGGESDNTKIGNWYYTYVVNGGNTGKKQYRSANKGAFTELSTESKNKLKKNIDYYVSLYMKADSKVSVDIEIDGKQESIVTDNITLDHVGYQRINILVPNLEGNEINTISIKGDGQTNVYWDDVSFVEVGAEEIEYKDPVPQFDIIEGDFDFFGDPLAVKYHDATYFIDSPLITQTPGTFSFTYKVIGEQTKTVLDSGSGKNANRINLDFKNVKSDRSFLYTLSCKDDLWGSTRTAVVRIFAVD

SEQ ID NO: 1458 - protein, 280 aa, Bacillus thuringiensis
MKRMEGKLFMVSKKLQVVTKTVLLSTVFSISLLNNEVIKAEQLNINSQSKYTNLQNLKITDKVEDFKEDKEKAKEWGKEKEKEWKLTATEKGKMNNFLDNKNDIKTNYKEITFSMAGSFEDEIKDLKEIDKMFDKTNLSNSIITYKNVEPTTIGFNKSLTEGNTINSDAMAQFKEQFLDRDIKFDSYLDTHLTAQQVSSKERVILKVTVPSGKGSTTPTKAGVILNNSEYKMLIDNGYMVHVDKVSKVVKKGVECLQIEGTLKKSLDFKNDINAEAHSWG

SEQ ID NO: 1459 - protein, 446 aa, Bacillus thuringiensis
MFMVSKKLQVVTKTVLLSTVFSISLLNNEVIKAEQLNINSQSKYTNLQNLKITDKVEDFKEDKEKAKEWGKEKEKEWKLTATEKGKMNNFLDNKNDIKTNYKEITFSMAGSFEDEIKDLKEIDKMFDKTNLSNSIITYKNVEPTTIGFNKSLTEGNTINSDAMAQFKEQFLDRDIKFDSYLDTHLTAQQVSSKERVILKVTVPSGKGSTTPTKAGVILNNSEYKMLIDNGYMVHVDKVSKVVKKGVECLQIEGTLKKSLDFKNDINAEAHSWGMKNYEEWAKDLTDSQREALDGYARQDYKEINNYLRNQGGSGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKVTEVIIKVLSDM

SEQ ID NO: 1460 - protein, 446 aa, Bacillus thuringiensis; identical to SEQ ID NO: 1459

SEQ ID NO: 1461 - protein, 462 aa, Bacillus thuringiensis tenebrionis
MQRMEGKLFVVSKTLQVVTRTVLLSTVYSITLLNNVVIKADQLNINSQSKYTNLQNLKIPDNAEDFKEDKGKAKEWGKEKGEEWRPPATEKGEMNNFLDNKNDIKTNYKEITFSMAGSCEDEIKDLEEIDKIFDKANLSSSIITYKNVEPATIGFNKSLTEGNTINSDAMAQFKEQFLGKDMKFDSYLDTHLTAQQVSSKKRVILKVTVPSGKGSTTPTKAGVILNNNEYKMLIDNGYVLHVDKVSKVVKKGMECLQVEGTLKKSLDFKNDINAEAHSWGMKIYEDWAKNLTASQREALDGYARQDYKEINNYLRNQGGSGNEKLDAQLKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKATEVIIKGVKRYVVDATLLTN

SEQ ID NO: 1462 - protein, 280 aa, Bacillus thuringiensis
MKRMEGKLFMVSTKLQAVTKAVLLSTVLSISLLNNEVIKAEQLNMNSQNKYTNFENLKITDKVEDFKEDKEKAKEWGKEKEKEWKLTATEKGKMNNFLDNKNDIKTNYKEITFSMAGSFEDEIKDLKEIDKIFDKANLSSPIITYKNVEPATIGFNKSLTEGNTINSDAMAQFKEQFLDRDIKFDSYLDTHLTVQQVSSKERVILKVKVPSGKGSTTPTKAGIILNNSEYKMLIDNGYMVHVDKVSKVVKKGVECLQVEGTLKKSLDFKNDINAGAHSWG

SEQ ID NO: 1463 - protein, 457 aa, Brevibacillus laterosporus
MIVIIFTNVKGGNELKKNFYKNLICMSALLLAMPISSNVTYAYGSEKVDYLVKTTNNTEDFKEDKEKAKEWGKEKEKEWKLTVTEKTRMNNFLDNKNDIKKNYKEITFSMAGSFEDEIKDLKEIDKMFDKANLSSSIVTYKNVEPSTIGFNKPLTEGNTINTDVQAQFKEQFLGKDIKFDSYLDTHLTAQNVSSKERIILQVTVPSGKGSTIPTKAGVILNNNEYKMLIDNGYVLHVDNISKVVKKGYECLQIQGTLKKSLDFKNDINAEAHRWGMKNYEGWAKNLTDPQREALDGYARQDYKQINDYLRNQGGSGNEKLDTQIKNISEALEKQPIPENITVYRWCGMAEFGYQISDPLPSLKEMEEKFLNTMKEDKGYMSTSLSSERLSAFGSRKFILRLQVPKGSTGAYLSAIGGFASEKEILIDKDSNYHIDKITEVVIKGVKRYVVDATLLTK

SEQ ID NO: 1464 - protein, 462 aa, Bacillus thuringiensis serovar israelensis
MQRMEGKLFMVSKKLQAVTKTVLLSTVLSISLLNNEEVKAEQLNINSQNKYTNFQNLKITDNAEDFKEDKEKAKEWGEEKEKEWKLTATEKGKMNNFLDNKNDIKTNYKEITFSMAGSFEDEIKDLKEIDKIFDKANLSSSIITYKNVEPATIGFNKSLTEGNTINSDAMAQFKEQFLGKDMKFDSYLDTHLTAHQVSSKKRVILKVTVPSGKGSTTPTKAGVILTNNEYKMLIDNGYVLHVDKVSKVVKKGMECLQVEGTLKKSLDFKNDINAEAHSWGMKIYEDWAKNLTASQREALDGYARQDYKEINNYLRNQGGSGNEKLDAQIKNISDALGKKPIPENITVYRWCGMPEFGYQISDPLPSLKDFEEQFLNTIKEDKGYMSTSLSSERLAAFGSRKIILRLQVPKGSTGAYLSAIGGFASEKEILLDKDSKYHIDKATEVIIKGVKRYVVDATLLTN

SEQ ID NO: 1465 - protein, 280 aa, Bacillus thuringiensis serovar israelensis
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTTPTKAGVILDGNEHKMLIDNGYVLHVDKVSKVVKRGLECLQVEGTLKKSLDFKNDISAKAHSWG

SEQ ID NO: 1466 - protein, 462 aa, Bacillus thuringiensis serovar israelensis
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTNPTKAGVILDGNEHKMLIDNGYVLHVDKVSKVVKKGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 1467 - protein, 280 aa, Bacillus thuringiensis
MKRMEGKLFMVSRKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTNPTKAGVILDGNEPKMLIDNGYVLHVDKVSKVVKKGLECLQVEGTLKKSLDFKNDISAKAHSWG

SEQ ID NO: 1468 - protein, 462 aa, Bacillus thuringiensis
MKRMEGKLFMVSKKLQLVTKALLFSTVLSIPLLNNEEVKAEHLNLNSQSKYPSFQNQKITDNAEDFKEDKEKAKEWGEVKEKEWKLTATEKRKINDFLNDTNKIKTNYKEITFSMAGSFEDELKDLKEIDKMFDKANLSSSIITYKNVEPATIGFNKSLTEGNTINSDVMAQFKEQFLGKDIKFDSYLDTHLTVQQVSSKERVILKVTVPSGKGSTTPTKAGVILDGNEHKMLIDNGYVLHVDKVSKVVKRGLECLQVEGTLKKSLDFKNDISAKAHSWGMKNYEEWAANLTDSQRKALDGYARQDYKKINDYLRNQGGSGNEQLDAQIKNISETLNNKPIPENITVYRWCGMPEFGYQISEPLPALKDFEWEFLNTIKEDKGYISTSLSSERLAAFGSRKIILRLQIPKGSKGAYLSAIGGFANEKEILLDKDSKYHINKITEVVIKGIKRYVVDATLLTN

SEQ ID NO: 1469 - protein, 451 aa, Bacillus laterosporus
MVSKKLQLITKTLVFSTVLSIPLLNNSEIKAEQLNMNSQIKYPNFQNINIADKPVDFKEDKEKAREWGKEKEKEWKLTVTEKGKINDFLDDKDGLKTKYKEINFSKNFEYETELKELEKINTMLDKANLTNSIVTYKNVEPTTIGFNQSLIEGNQINAEAQQKFKEQFLGQDIKFDSYLDMHLTEQNVSSKERVILKVTVPSGKGSTPTKAGVVLNNNEYKMLIDNGYVLHVENITKVVKKGQECLQVEGTLKKSLDFKNDSDGKGDSWGKKNYKEWSDTLTTDQRKDLNDYGVRGYTEINKYLREGDTGNTELEEKIKNISDALEKNPIPENITVYRYCGMAEFGYPIKPEAPSVQDFEERFLDTIKEEKGYMSTSLSSDATSFGARKIILRLQVPKGSSGAYVAGLDGFKPAEKEILIDKGSKYRIDKVTEVVVKGTRKLVVDATLLTK

SEQ ID NO: 1470 - protein, 350 aa, Bacillus laterosporus
MKRMEERLFMVSKKLQLITKTLVFSTVLSIPLLNNSEIKAEQLNMNSQIKYPNFQNINIADKPVDFKEDKEKAREWGKEKEKEWKLTATEKGKINDFLDDKDGLKTKYKEINFSKNFEYETELKELEKINTMLDKANLTNSIVTYKNVEPTTIGFNQSLIEGNQINAEAQQKFKEQFLGQDIKFDSYLDMHLTEQNVSSKERVILKVTVPSGKGSTPTKAGVVLNNNEYKMLIDNGYVLHVENITKVVKKGQECLQVEGTLKKSLDFKNDSDGKGDSWGKKNYKEWSDTLTTDQRKDLNDYGARGYTEINKYLREGGTGNTELEEKIKNISDALEKNPIPENITVYRYCG

SEQ ID NO: 1471 - protein, 350 aa, Bacillus thuringiensis; identical to SEQ ID NO: 1470

SEQ ID NO: 1472 - protein, 350 aa, Bacillus thuringiensis serovar israelensis; identical to SEQ ID NO: 1470

SEQ ID NO: 1473 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAQAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1474 - protein, 789 aa, Bacillus thuringiensis; identical to SEQ ID NO: 1473

SEQ ID NO: 1475 - protein, 746 aa, Bacillus thuringiensis
MNKNNAKLSTRALPSFIDYFNGIYGFATGIKDIMNMIFKTDTGGDLALDEILENQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADIRDELSELTELAKSVTQNDVDGFEFYLNTFHDVMVGNNLFGRSALKTASELITKENVKTSGSEVGNVYNFLIVLTALQAQAFLTLTPCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSGQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKKDI

SEQ ID NO: 1476 - protein, 790 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPANILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYKTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDNLKPKTEYVIQYTVKGKPSIHLIDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIKP

SEQ ID NO: 1477 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVDNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFIKNIVENGSIEEDNLEPWKANNKNEYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKFGKDNFYIELSQGNNLNGGPIVQFPDVSIK

SEQ ID NO: 1478 - protein, 790 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIKP

SEQ ID NO: 1479 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1480 - protein, 789 aa, Bacillus thuringiensis; identical to SEQ ID NO: 1479

SEQ ID NO: 1481 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFGKRYMSGAKDVSEMFTTKFEKDNFYIELSQGNNLYGGPIVHFYDVSIK

SEQ ID NO: 1482 - protein, 789 aa, Bacillus thuringiensis; identical to SEQ ID NO: 1479

SEQ ID NO: 1483 - protein, 789 aa, Bacillus thuringiensis; identical to SEQ ID NO: 1479

SEQ ID NO: 1484 - protein, 789 aa, Bacillus thuringiensis; identical to SEQ ID NO: 1479

SEQ ID NO: 1485 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEHRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1486 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTGLAKSVPKNDVDGFEFYLNTFHDVMVGNNLFGRSALKTASELITKENVKTSGSEVGNVYNSLIVLTLLQAKAFLTLTTCRKLLGLADIDYTSIMNEHLNKEKEEFRVNIPPTLSNTFSNPNYAKVKGSDEDAKMIVEAKPGHALVGFEISNDSITVLKVYEAKLKQNYQVDKDSLSEVIYGDMDKLLGPDQSGPIYYPNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFIKNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKLGKDNFYIELSQGNNLNGGPIVKFYDVSIK

SEQ ID NO: 1487 - protein, 789 aa, Bacillus thuringiensis; identical to SEQ ID NO: 1479

SEQ ID NO: 1488 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKLTSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1489 - protein, 790 aa, Bacillus thuringiensis; identical to SEQ ID NO: 1478

SEQ ID NO: 1490 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKTSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1491 - protein, 789 aa, Bacillus thuringiensis
MNKNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGYALVGFEMSNDSITVLKVYEAKLKQNYQVDKDSLSEVIYGDTDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADGNSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDNFIILEISPSEKLLSPELINTNNWTSTGSTHISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1492 - protein, 789 aa, Bacillus thuringiensis; identical to SEQ ID NO: 1473

SEQ ID NO: 1493 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVIKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAQAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1494 - protein, 789 aa, Bacillus thuringiensis; identical to SEQ ID NO: 1479

SEQ ID NO: 1495 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNGYVITKIDFTKKMKTLRYEVTANFYDSSTGEIDLNKKKVESSEAEYRTLSANDDGVYMPLGVISETFLTPINGFGLQADENSRLITLTCKSHLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1496 - protein, 789 aa, Bacillus thuringiensis
MNKNNTKLSTRALPGFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELAFATETSSKVKKDGSPADILDELTELTELAKSVTKNDVDGFEFYLNTFHDVMVGNNLFGRSALKTASELITKENVKTSGSGVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1497 - protein, 789 aa, Vip3Aa24
MNKNNTKLSTRALPSFIDYFNGIYGFATGIKDIMNMIFKTDTGGDLTLDEILKNQQLLNDISGKLDGVNGSLNDLIAQGNLNTKLSKEILKIANEQNQVLNDVNNKLDAINTMLRVYLPKITSMLSDVMKQNYALSLQIKYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQADKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIYHLHDVSIK

SEQ ID NO: 1498 - protein, 789 aa, Bacillus thuringiensis; identical to SEQ ID NO: 1497

SEQ ID NO: 1499 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILRIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSNEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINEFGLQADENSRLITLTCKSYLREPLLATDLSNKETKLIVPPSGFISNIVENGSIEEDNLEPWKANNKNAYVDHTGGVNGTKALYVHKDGGISQFIGDKLKPKTEYVIQYTVKGKPSIRLKDENTGYIHYEDTNNNLEDYQTINKRFTTGADLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYTELSQGNNLYGGPIVHFYDVSIK

SEQ ID NO: 1500 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNGVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDELLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNLIILEISPSEKLLSPELINTNNWTSTGSTNISGNTLTLYQGGRGILKQNLQLDSLSTYRVYFSVSGDANVRIRNSREVLFEKRYMSGAKDVSEMFTTKFEKDNFYIELSQGNNLYGGPIVHFYDVSIK

SEQ ID NO: 1501 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGHSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIS

SEQ ID NO: 1502 - protein, 788 aa, Bacillus thuringiensis
MNKNNTKLSNFRCLYLVEYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMYTPKFEKDNFYIELLKAKNKNKLIALFYDVSIK

SEQ ID NO: 1503 - protein, 787 aa, Bacillus thuringiensis
MNKNNTKLSHVVVISFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPETEYVIQYTVKGKPSIHLKDENTGYIPYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIEPLKGITIWVNSPFYDVSIK

SEQ ID NO: 1504 - protein, 788 aa, Bacillus thuringiensis
MNKNNTKLSNVNELSSLSDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELLKGRTRIDLSPFYDVSIK

SEQ ID NO: 1505 - protein, 788 aa, Bacillus thuringiensis
MNKNNTKLSKNELSRLSDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGKNKNRLNGPFYDVSIK

SEQ ID NO: 1506 - protein, 789 aa, Bacillus thuringiensis; identical to SEQ ID NO: 1479

SEQ ID NO: 1507 - protein, 789 aa, Bacillus thuringiensis; identical to SEQ ID NO: 1479

SEQ ID NO: 1508 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFIKNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKLGKDNFYIELSQGNNLNGGPIVKFSDVSIK

SEQ ID NO: 1509 - protein, 789 aa, Bacillus thuringiensis; identical to SEQ ID NO: 1479

SEQ ID NO: 1510 - protein, 789 aa, Bacillus thuringiensis; identical to SEQ ID NO: 1479

SEQ ID NO: 1511 - protein, 789 aa, Bacillus thuringiensis
MNMNNTKLNARALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEVSNDSITVLKVYEAKLKQNYQVDKDFLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1512 - protein, 789 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDMDKLLCPDQSEQIYYTNNIVFPNEYVITKIDFTKKMKTLRYEVTANSYDSSTGEIDLNKKKVESSEAEYRTLSAKDDGVYMPLGVISETFLTPINGFGLQADENSRLITLTCKSYLRELLLATDLSNKETKLIVPPSGFISNIVENGNLEGENLEPWIANNKNAYVDHTGGVNGTRALYVHKDGGFSQFIGDKLKPKTEYVIQYTVKGKPSIHLKNENTGYIHYEDTNNNLEDYQTITKRFTTGTDLKGVYLILKSQNGDEAWGDNFTILEISPSEKLLSPELINVNNWIRTGSTHISGNTLTLYQGGGGNLKQNLQLDSFSTYRVNFSVTGDANVRIRNSREVLFEKRYMSGAKDVSEIFTTKLGKDNFYIELSQGNNLYGGPLVKFNDVSIK

SEQ ID NO: 1513 - protein, 789 aa, Bacillus thuringiensis
MNKNNTKLSARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDMDKLLCPDQSEQIYYTNNIVFPNEYVITKIDFTKKMKTLRYEVTANSYDSSTGEIDLNKKKVESSEAEYRTLSAKDDGVYMPLGVISETFLTPINGFGLQADENSRLITLTCKSYLRELLLATDLSNKETKLIVPPSGFISNIVENGNLEGENLEPWIANNKNAYVDHTGGVNGTRALYVHKDGGFSQFIGDKLKPKTEYVIQYTVKGKPSIHLKNENTGYIHYEDTNNNLEDYQTITKRFTTGTDLKGVYLILKSQNGDEAWGDNFTILEISPSEKLLSPELINVNNWIRTGSTHISGNTLTLYQGGGGNLKQNLQLDSFSTYRVNFSVTGDANVRIRNSREVLFEKRYMSGAKDVSEIFTTKLGKDNFYIELSQGNNLYGGPLVHFYDVSIK

SEQ ID NO: 1514 - protein, 789 aa, Bacillus thuringiensis
MNMNNTKLSARALPSLIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLLGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDMDKLLCPDQSEQIYYTNNIVFPNEYVITKIDFTKKMKTLRYEVTANSYDSSTGEIDLNKKKVESSEAEYRTLSAKDDGVYMPLGVISETFLTPINGFGLQADENSRLITLTCKSYLRELLLATDLSNKETKLIVPPSGFISNIVENGNLEGENLEPWIANNKNAYVDHTGGVNGTRALYVHKDGGFSQSIGDKLKPKTEYVIQYTVKGKPSIHLKNENTGYIHYEDTNNNLEDYQTITKRFTTGTDLKGVYLILKSQNGDEAWGDNFTILEISPSEKLLSPELINVNNWIRTGSTHISGYTLTLYQGGGGNLKQNLQLDSFSTYRVNFSVTGDANVRIRNSREVLFEKRYMSGAKDVSEIFTTKLGKDNFYIELSQGNNLYGGPLVHFYDVSIK

SEQ ID NO: 1515 - protein, 789 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISEAFLTPINGFGLQADENSRLITLTCKSYLRELLLATDLSNKETKLIVPPSGFIKNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTITKRFTTGTDLKGVYLILKSQNGDEAWEDNFIILEISPSEKLLSPELINTNNWTSTGSTNISGNTLTLYQGGRGILKQNLQLDSFSTYRVYFSVSGDANVRIRNSREVLFEKRYMSGAKDVSEIFTTKLGKDNFYIELSQGNNLNGGPIVKFSDVSIK

SEQ ID NO: 1516 - protein, 789 aa, Bacillus thuringiensis; identical to SEQ ID NO: 1479

SEQ ID NO: 1517 - protein, 789 aa, Bacillus thuringiensis; identical to SEQ ID NO: 1479

SEQ ID NO: 1518 - protein, 789 aa, Bacillus thuringiensis
MNKNNTKLSTRALPSFIDYFNGIYGFATGIKDIINMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSIK

SEQ ID NO: 1519 - protein, 789 aa, Bacillus thuringiensis; identical to SEQ ID NO: 1518

SEQ ID NO: 1520 - protein, 788 aa, Bacillus thuringiensis
MNKNNTKLSTRALPSFIDYFNGVYGFATGIKDIMNMIFKTDTGGDLTLDEILKNQQLLNDISGKLDGVNGSLNDLIAQGNLNTELSKEILKIANEQNQVLNDVNNKLDAINTMLRVYPPKITSMLSDVMKQNYALSLQIEYLSKQLQEISDKLDIINVNVLINSTLTEITPAYQRIKYVNEKFEELTFATETSSKVKRDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANLYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTKYVIQYTVKGKPSIHLKDENTGYIHYEDTNNNLEDYQTINKRFTTGTDLKGVYLILKSQNGDEAWGDNFIILEISPSEKLLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSI

SEQ ID NO: 1521 - protein, 788 aa, Bacillus thuringiensis; identical to SEQ ID NO: 1520

SEQ ID NO: 1522 - protein, 788 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVRVGNNLFGRSALKTASELITKENVKTSGSEVGNVYNFLIVLTALQAKAFLTLTTCRKLLGLADIDYTSIMNEHLSKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVTQYTVKGKPSIHLKDENTGYIHYEDTNNNLEDYQTINKRFTTGTDLKGVYLILKSQNGDEAWGDNFIILEISPSEKSLSPELINTNNWTSTGSTNISGNTLTLYQGGRGILKQNLQLDSFSTYRVYFSVSGDANVRIRNSREVLFEKRYMSGAKDVSEMFTTKFEKDNFYIELSQGNNLYGGPIVHFYDVSI

SEQ ID NO: 1523 - protein, 788 aa, Bacillus thuringiensis; identical to SEQ ID NO: 1522

SEQ ID NO: 1524 - protein, 787 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQVEYLSKQLKEISDKLDVINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEISNDSMTVLKVYEAKLKQNYQVDKDSLSEVIYSDMDKLLCPDQSEQIYYTNNIVFPNEYVITKIDFTKKMKTLRYEVTANSYDSSTGEIDLNKKKVESSEAEYRTLSANNDGVYMPLGVISETFLTPINGFGLQADENSRLITLTCKSYLRELLLATDLSNKETKLIVPPISFISNIVENGNLEGENLEPWIANNKNAYVDHTGGINGTKVLYVHKDGEFSQFVGGKLKSKTEYVIQYIVKGKASIYLKDKKNENSIYEEINNDLEGFQTVTKRFITGTDSSGIHLIFTSQNGEGAFGGNFIISEIRTSEELLSPELIMSDAWVGSQGTWISGNSLTINSNVNGTFRQNLPLESYSTYSMNFTVNGFGKVTVRNSREVLFEKSYPQLSPKDISEKFTTAANNTGLYVELSRSTSGGAINFRDFSIK

SEQ ID NO: 1525 - protein, 787 aa, Bacillus thuringiensis; identical to SEQ ID NO: 1524

SEQ ID NO: 1526 - protein, 787 aa, Bacillus thuringiensis; identical to SEQ ID NO: 1524

SEQ ID NO: 1527 - protein, 786 aa, Bacillus thuringiensis
MQKNNKLSVKALPSFIDYFNGIYGFATGIKDIMNMIFKTNTGGDLTLDEILKNQQLLNEISGKLDGVNGSLNDLLAQGNLDTELSKEILKIANEQNKVLNDVNTKLDAINLMLNTYLPKITSMLSDVMKQNYALGLQIEYLSKQLKEISDKLDVINVNVLINSTLTEITPAYQRIKYVNEKFEALTSATETNLKTKQDSSHTDILDELTELTELAKSVTKNDVDGFEFYLNTFHDVMIGNNLFGRSALKTASELIAKENLKTSGSEVGNVYNFLIVLTALQAKAFLTLTTCRKLLGLADIDYTPIMNEHLNKEKEEFRVNILPTLSNTFSNPNYEKARGSDKDAKIIMEAKPGYALVGFEISKDSIAVLKVYQAKLKHNYQIDKDSLSEIVYGDIDKLLCPDQSEQMYYTNKIAFPNEYVITKIAFTKKLNSLRYEVTANFYDSSTGDIDLNKKKIESSEAEFSMLNANNDGVYMPIGTISETFLTPINGFGLVVDENSRLVTLTCKSYLRETLLATDLSNKETKLIVPPNGFISNIVENGNLEGENLEPWKANNKNAYVDHTGGVNGTKVLYVHEDGEFSQFIGDKLKLKTEYVIQYIVKGKAAIYLKDEKNGDYIYEETNNELEDFQAVTKRFITGTDSSRVHLIFTSQNGEEAFGGNFIISEIRPSEELLSPELIKSDAWVGSQGTWISGNSLNINSNVNGTFRQNLSLESYSTYSMNFNVNGFGKVTIRNSREVVFERSYLQFSSKYISEKFTTTTNNTGLYVELSRASSRGVINFGDFSIK

SEQ ID NO: 1528 - protein, 786 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELAKQILKVANEQNQVLNDVNNKLDAINSMLKIYLPKITSMLSDVMKQNYVLSLQIEYLSKQLQEISDKLDIINVNVLINSTLTEITPAYQRIKYVNEKFDDLTFATENTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKAKGSNEDTKMIVEAKPGYVLVGFEMSNNSITVLKAYQAKLKKDYQIDKDSLSEIIYSDTDKLLCPDQSEQIYYTKNIAFPNEYVITKIAFTKKMNSLRYEATANFYDSSTGDIDLNKTKVESSEAEYSMLKASDDEVYMPLGLISETFLNPINGFRLAVDENSRLVTLTCRSYLRETLLATDLNNKETKLIVPPNVFISNIVENGNIEMDTLEPWKANNENANVDYSGGVNGTRALYVHKDGEFSHFIGDKLKSKTEYLIRYIVKGKASIFLKDEKNENYIYEDTNNNLEDYQTITKRFTTGTDSTGVYLIFNSQNGDEAWGDNFIILEISPCEKLLSPELIKTDKWISTGSTYISDDRLTLYQGGRGILKQNLQLDRFSTYRVNFSVNGDANVRIRNSREVLLEKRYLNRKGVSEMFTTKFDKDNFYVELSQGDNLGTVVHFYDFSIK

SEQ ID NO: 1529 - protein, 786 aa, Bacillus thuringiensis
MNMNNAKLNARALPSFIDYFNGIYGFATGIKDIMNMIFKTDTGSNLTLDEILKNQQLLNEISGKLDGVNGSLNDLIAQGNLNTELAKQILKVANEQNQVLNDVNNKLDAINSMLKIYLPKITSMLSDVMKQNYVLSLQIEYLSKQLQEISDKLDIINVNVLINSTLTEITPAYQRMKYVNEKFEELTFATETTLKVKKDSPPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKAKGSNEDTKMIVEAKPGYVLVGFEMSNDSITVLKAYQAKLKKDYQIDKDSLSEIIYSDTDKLLCPDQSEQIYYTKNIAFPNEYVITKIAFTKKMNSLRYEATANFYDSSTGDIDLNKTKVESSEAEYSMLKASDDEVYMPLGLISETFLNPINGFRLAVDENSRLVTLTCRSYLRETLLATDLNNKETKLIVPPNVFISNIVENGNIEMDTLEPWKANNENANVDYSGGVNGTRALYVHKDGEFSHFIGDKLKSKTEYLIRYIVKGKASIFLKDEKNENYIYEDTNNNLEDYQTITKRFTTGTDSTGVYLIFNSQNGDEAWGDNFIILEISPCEKLLSPELIKTDKWNSTGSTYISDDRLTLYRGGRGILKQNLQLDGFSTYRVNFSVDGDANVRIRNSREVLLEKRYLNRKGVSEMFTTKFDKDNFYVELSQGDNLGTIVHFYDFSIK

SEQ ID NO: 1530 - protein, 787 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKEDGSPADILDELTELTELAKSVTKNEVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYVKAKGSDRDAKMIVEAKPGYALVGFEMSNDSMTVLKAYQAKLKQDYQVDKDSLSEIVYGDMNKLLCPDQSEQIYYTNNIAFPREYVITKLTFTKKMNSLRYEATANFYDSSTGDMDLNKTKVESSEAEYSRLSASNDGVYMPLGLISETFLTPINGFGLVVDENSRLVTLTCKSYLREILLATDLSNKETKLIVPPNGFISNIVENGNLEGENLEPWKANNKNAYIDHTGGVKGTKVLYVHKDGEFSQFIGYKLKSKTEYVIQYIVKGKAVIYLKDEKNGDYIYEEINNELEDFQTVTKRFITGTDSSGVHLIFTSQNGEEAFGGNFIISEIRPSEELLSPELIKSDAWVGTQGAWNSGNSLTIYTNTNGTFRQNLPLESYSTYSMNFNITGFGKVTIRNSREVLFEKNFSQLSPKDYSEKFTTAANNTGFYVELSRGTQGGNITFRDFSIK

SEQ ID NO: 1531 - protein, 788 aa, Bacillus thuringiensis
MNMNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSREVLFERSNLMSSTSHISGTFKTESNNTGLYVELSRRSGGGGHISFENVSIK

SEQ ID NO: 1532 - protein, 787 aa, Bacillus thuringiensis
MNKNNTKLSTRALPSFIDYFNGIYGFATGIKDIMNMIFKTDTGGNLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETTLKVKKDSSPADILDELTELTELAKSVTKNDVDGFEFYLNTFHDVMVGNNLFGRSALKTASELIAKENVKTSGSEVGNVYNFLIVLTALQAKAFLTLTTCRKLLGLAGIDYTSIMNEHLNKEKEEFRVNILPTLSNTFSNPNYAKVKGSDEDAKMIVEAKPGHALVGFEMSNDSITVLKVYEAKLKQNYQVDKDSLSEVIYGDTDKLFCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGFSQFIGDKLKPKTEYVIQYTVKGKPSIHLKDENTGYIHYEDTNNNLKDYQTITKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSRVLFERSNLMSSTSHISGTFKTESNNTGLYVELSRRSGGGGHISFENVSIK

SEQ ID NO: 1533 - protein, 788 aa, Bacillus thuringiensis
MNKNNTKLSTRALPSFIDYFNGIYGFATGIKDIMNMIFKTDTGGDLTLDEILKNQQLLNDISGKLDGVNGSLNDLIAQGNLNTELSKEILKIANEQNQVLNDVNNKLDAINTMLRVYLPKITSMLSDVMKQNYALSLQIEYLSKQLQEISDKLDIINVNVLINSTLTEITPAYQRIKYVNEKFEELTFATETSSKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYAKVKGSDEDAKMIVEAKPGHALIGFEISNDSITVLKVYEAKLKQNYQVDKDSLSEVIYGDMDKLLCPDQSEQIYYTNNIVFPNEYVITKIDFTKKMKTLRYEVTANFYDSSTGEIDLNKKKVESSEAEYRTLSANDDGVYMPLGVISETFLTPINGFGLQADENSRLITLTCKSYLRELLLATDLSNKETKLIVPPSGFISNIVENGSIEEDNLEPWKANNKNAYVDHTGGVNGTKALYVHKDGGISQFIGDKLKPKTEYVIQYTVKGKPSIHLKDENTGYIHYEDTNNNLEDYQTINKRFTTGTDLKGVYLILKSQNGDEAWGDKFTILEIKPAEDLLSPELINPNSWITTPGASISGNKLFINLGTNGTFRQSLSLNSYSTYSISFTASGPFNVTVRNSRGVLFERSNLMSSTSHISGTFKTESNNTGLYVELSRRSGGGGHISFENVSIK

SEQ ID NO: 1534 - protein, 788 aa, Bacillus thuringiensis; identical to SEQ ID NO: 1531

SEQ ID NO: 1535 - protein, 787 aa, Bacillus thuringiensis
MNKNNTKLNARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKQDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYMPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNSREVLFEKNYPQLSPKDISEKFTTAANNTGLYVELSRFTSGGAINFRNFSIK

SEQ ID NO: 1536 - protein, 787 aa, Bacillus thuringiensis
MNKNNTKLSARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKRDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYTPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNPREVLFEKNYPQLSPKDISEKFTTAANNTGLYVELSRFTSGGAINFRDFSIK

SEQ ID NO: 1537 - protein, 840 aa, Bacillus thuringiensis
  MISC_FEATURE (58)..(58): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MNMNNTKLNARALPSFIDYFNGIYGFATGIKDIMNMIFKTDTGGNLTLDEILKNQQLXNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKQDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYMPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNSREVLFEKNYPQLSPKDISEKFTTAANNTGLYVELSRFTSGGAINFRDFSIKLVDPNSVQARLQDVDGTIDTRSKLAAAQLYTRASQPELAPEDPEDLEHHHHHH

SEQ ID NO: 1538 - protein, 787 aa, Bacillus thuringiensis; identical to SEQ ID NO: 1535

SEQ ID NO: 1539 - protein, 787 aa, Bacillus thuringiensis
MNKNNTKLSARALPSFIDYFNGIYGFATGIKDIMNMIFKTDTGGNLTLDEILKNQQLLNEISGKLDGVNGSLNDLIAQGNLNTELSKEILKIANEQNQVLNDVNNKLNAINTMLHIYLPKITSMLNDVMKQNYALSLQIEYLSKQLQEISDKLDVINVNVLINSTLTEITPAYQRMKYVNEKFEDLTFATETTLKVKKNSSPADILDELTELTELAKSVTKNDVDGFEFYLNTFHDVMVGNNLFGRSALKTASELIAKENVKTSGSEVGNVYNFLIVLTALQAKAFLTLTTCRKLLGLADIDYTFIMNEHLDKEKEEFRVNILPTLSNTFSNPNYAKAKGSNEDAKIIVEAKPGYALVGFEMSNDSITVLKAYQAKLKQDYQVDKDSLSEIVYGDMDKLLCPDQSEQIYYTNNIAFPNEYVITKITFTKKMNSLRYEATANFYDSSTGDIDLNKTKVESSEAEYSTLSASTDGVYMPLGIISETFLTPINGFGIVVDENSKLVNLTCKSYLREVLLATDLSNKETKLIVPPIGFISNIVENGNLEGENLEPWKANNKNAYVDHTGGVNGTKALYVHKDGEFSQFIGDKLKSKTEYVIQYIVKGKASILLKDEKNGDCIYEDTNNGLEDFQTITKSFITGTDSSGVHLIFNSQNGDEAFGENFTISEIRLSEDLLSPELINSDAWVGSQGTWISGNSLTINSNVNGTFRQNLSLESYSTYSMNFNVNGFAKVTVRNSREVLFEKNYPQLSPKDISEKFTTAANNTGLYVELSRFTSGGAINFRDFSIK

SEQ ID NO: 1540 - protein, 795 aa, Bacillus thuringiensis
MNKNNTKLSTRALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLHIYLPKITSMLSDVMKQNYALSLQIEYLSKQLQEISDKLDIINVNVLINSTLTEITPAYQRIKYVNEKFEELTFATETNLKVKKDGSPADILDELTELTELAKSVTKNDVDGFEFYLNTFHDVMVGNNLFGRSALKTASELITKENVKTSGSEVGNVYNFLIVLTALQAKAFLTLTTCRKLLGLADIDYTSIMNEHLNKEKEEFRVNILPTLSNTFSNPNYIKTKGSDEDAEVIIQAEPGHALVGFEMINDPSPALKVYQAKLKPNYQVDKQSLSETVYGDMDKILCPDKSQQMYYLHNITFPNEYVITEIIFTKKKNSLRYEVIANYYEFSSGDIDLNKKLVKSSEAEYSTLSVSNDAIYMPLGVISETFLTPIKGFGLTVDESSRLVTLTCKSYLREILLATDLSNKATKLIVPPNGFISNLVENGDIEADNIEPWKGNNKNAYVDHTGGVNGTKALYTQDDGEFSQFIGDKLKSKTEYIIQYTVKGNTSIYLKDKKNENVIYEDKNNNLEAFQTITKRFTTELDSSDVYLVFKCKNGYKAWGDNFLITEIRPKEVVSPELIKVENWIGMGGSNHVNPDSLLLFTGGRSILKQNLQLDSYSTYRVRFSLMVIGKAKVIIRNSSEVLFEKSYVNDSEGVLEGVSETFTTKSIQDNFYVELSNEGTFGSKDVAYFYNFSIK

SEQ ID NO: 1541 - protein, 795 aa, Bacillus thuringiensis; identical to SEQ ID NO: 1540

SEQ ID NO: 1542 - protein, 803 aa, Bacillus thuringiensis
MNMNNTKLNARALPSFIDYFNGIYGFATGIKDIMNMIFKTDTGGGNLTLDEILKNQDLLNQISDKLDGINGDLGDLIAQGNLNSELTKELLKIANEQNLMLNNVNAQLNSINATLNTYLPKITSMLNEVMKQNYVLSLQIEFLSKQLQEISDKLDIINLNVLINSTLTEITPAYQRIKYVNDKFDELTSTVEKNPKINQDNFTEDVIDNLTDLTELARSVTRNDMDSFEFYIKTFHDVMIGNNLFSRSALKTASELIAKENIHTRGSEIGNVYTFMIVLTSLQAKAFLTLTTCRKLLGLADIDYTQIMNENLDREKEEFRLNILPTLSNDFSNPNYTETLGSDLVDPIVTLEAEPGYALIGFEILNDPLPVLKVYQAKLKPNYQVDKESIMENIYGNIHKLLCPKQREQKYYIKDMTFPEGYVITKIVFEKKLNLLGYEVTANLYDPFTGSIDLNKTILESWKEDCCEEDCCEEDCCEEDCCEELYKIIEADTNGVYMPLGVISETFLTPIYSFKLIIDEKTKKISLAGKSYLRESLLATDLVNKETNLIPSPNGFISSIVQNWHITSDNIEPWKANNKNAYVDKTDAMVGFSSLYTHKDGEFLQFIGAKLKAKTEYIIQYTVKGNPEVYLKNNKDICYEDKTNNFDTFQTITKKFNSGVDPSEIYLVFKNQIGYEAWGNNFIILEIKSLETLPQILKPENWIPLGNAEIKEDGKIEISGNGSMNQYIQLEQNSKYHLRFSVKGKGRVTMQAQTSHINVPATNEEVSIMIETTRLYGEGIISLLNDEVENSGVIFSDVSIVKE

SEQ ID NO: 1543 - protein, 803 aa, Bacillus thuringiensis; identical to SEQ ID NO: 1542

SEQ ID NO: 1544 - protein, 801 aa, Bacillus thuringiensis
MNNTKLNARALPSFIDYFNGIYGFATGIKDIMNMIFKTDTGGGNLTLDEILKNQDLLNQISDKLDGINGDLGDLIAQGNLNSELTKELLKIANEQNLMLNNVNAQLNSINSTLNTYLPKITSMLSEVMKQNYVLSLQIEFLSEQLQEISDKLDVINLNVLINSTLTEITPAYQRIKYVNDKFDELTSTVEKNPKINQDNFTEDVIDNLTDLTELARSVTRNDMDSFEFYIKTFHDVMIGNNLFSRSALKTASELIAKENIHTMGSEIGNVYTFMVVLTSLQAKAFLTLTACRKLLGLTDIDYTQIMNENLNREKEEFRLNILPTLSNDFSNPNYTETLGSDLVDPIVTLEADPGYALIGFEILNDPLPVLKVYQAKLKPNYQVDKESIMENIYGNIHKLLCPKQRHQKYYIKDITFPEGYVITKIVFEKKLNLLGYEVTANLYDPFTGSIDLNKTILESWKEECCEEECCEEECCEEECCEELYKIIEADTNGVYMPLGVISETFLTPIYSFKLIIDERTKRISLAGKSYLRESLLATDLVNKDTNLIPSPNGFINSIVENWNITSDNIEPWKANNKNAYVDKTDDMVGFNSLYTHKDGEFLQFIGAKLKAKTEYIIQYTVKGSPEVYLKNNKGIFYEDTTNKFDTFQTITKKFNSGVDPSEIYLVFKNQIGYEAWGNKFIILEIKSFETLPQILKPENWMPFGNAEIKEDGKIEISGNGTMTQNIQLEQNSKYHLRFSVKGKGRVAIQTQSSHINVPATNEEVSTMITTRNLYGEGMIYLFNDDVENSKVIFSDVSLVKE

SEQ ID NO: 1545 - protein, 801 aa, Bacillus thuringiensis; identical to SEQ ID NO: 1544

SEQ ID NO: 1546 - protein, 700 aa, Bacillus thuringiensis
MNNTKLNARALPSFIDYFNGIYGFATGIKDIMNMIFKTDTGGGNLTLDEILKNQDLLNQISDKLDGINGDLGDLIAQGNLNSELTKELLKIANEQNLMLNNVNAQLNSINSTLNTYLPKITSMLSEVMKQNYVLSLQIEFLSEQLQEISDKLDVINLNVLINSTLTEITPAYQRIKYVNDKFDELTSTVEKNPKINQDNFTEDVIDNLTDLTELARSVTRNDMDSFEFYIKTFHDVMIGNNLFSRSALKTASELIAKENIHTMGSEIGNVYTFMVVLTSLQAKAFLTLTACRKLLGLTDIDYTQIMNENLNREKEEFRLNILPTLSNDFSNPNYTETLGSDLVDPIVTLEADPGYALIGFEILNDPLPVLKVYQAKLKPNYQVDKESIMENIYGNIHKLLCPKQRQQKYYIKDITFPEGYVITKIVFEKKLNLLGYEVTANLYDPFTGSIDLNKTILESWKEECCEEECCEEECCEEECCEELYKIIEADTNGVYMPLGVISETFLTPIYSFKLIIDERTKRISLAGKSYLRESLLATDLVNKDTNLIPSPNGFISSIVENWNITSDNIEPWKANNKNAYVDKTDDMVGFNSLYTHKDGEFLQFIGAKLKAKTEYIIQYTVKGSPEVYLKNNKGIFYEDTTNKFDTFQTITKKFNSGVDPSEIYLVFKNQIGYEAWGNKFIILEIKSFETLPQILKPENW

SEQ ID NO: 1547 - protein, 490 aa, Bacillus thuringiensis
MNKNNTKLSARALPSFIDYFNGIYGFATGIKDIMNMIFKTDTGGGNLTLDEILKNQDLLNQISDKLDGINGDLGDLIAQGNLNSELIKELLKIANEQNLMLNNVNAQLNSINSTLNTYLPKITSMLSEVMKQNYVLSLQIEFLSEQLQEISDKLDVINLNVLINSTLTEITPAYQRIKYVNDKFDELTSTVEKNPKINQDNFTEDVIDNLTDLTELARSVTRNDMDSFEFYIKTFHDAMIGNNLFSRSALKTASELIAKENIHTMGSEIGNVYTFMVVLTSLQAKAFLTLTACRKLLGLTDIDYTQIMNENLNREKEEFRLNVLPTLSNDFSNPNYTETLGSDLVDPIVTLEADPGYALIGFEILNDPLPVLKVYQAKLKPNYQVDKESIMENIYGNIHKLLCPKQRQQKYYIKDITFPEGYVITKIVFEKKLNLLGYEVTANLYDPFTGSIDLNKTILESWKEECCEEECCEEECCEEECCEELYKIIE

SEQ ID NO: 1548 - protein, 803 aa, Bacillus thuringiensis
MNKNNTKLNARALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLNIYLPKITSMLSDVMKQNYALSLQIEYLSRQLQEISDKLDVINLNVLINSTLTEITPSYQRIKYVNEKFDKLTFATESTLRAKQGIFNEDSFDNNTLENLTDLAELAKSITKNDVDSFEFYLHTFHDVLIGNNLFGRSALKTASELITKDEIKTSGSEIGKVYSFLIVLTSLQAKAFLTLTTCRKLLGLSDIDYTSIMNEHLNNEKNEFRDNILPALSNKFSNPSYAKTIGSDNYAKVILESEPGYALVGFEIINDPIPVLKAYKAKLKQNYQVDNQSLSEIVYLDIDKLFCPENSEQKYYTKNLTFPDGYVITKITFEKKLNNLIYEATANFYDPSTGDIDLNKKQVESTFPQTDYITMDIGDDDGIYMPLGVISETFLTPINSFGLEVDAKSKTLTLKCKSYLREYLLESDLKNKETGLIAPPNVFISNVVKNWDIEEDSLEPWVANNKNAYVDNTGGIERSKALFTQGDGEFSQFIGDKLKPNTDYIIQYTVKGKPAIYLKNKSTGYITYEDTNGNSEEFQTIAVKFTSETDLSQTHLVFKSQNGYEAWGDNFIILEAKLFETPESPELIKFNDWERFGTTYITGNELRIDHSRGGYFRQSLNIDSYSTYDLSFSFSGLWAKVIVKNSRGVVLFEKVKNNGSSYEDISESFTTASNKDGFFIELTAERTSSTFHSFRDISIKEKIE

SEQ ID NO: 1549 - protein, 803 aa, Bacillus thuringiensis
MNMNNTKLNARALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLNIYLPKITSMLSDVMKQNYALSLQIEYLSRQLQEISDKLDVINLNVLINSTLTEITPSYQRIKYVNEKFDKLTFATESTLRAKQGIFNEDSFDNNTLENLTDLAELAKSITKNDVDSFEFYLHTFHDVLIGNNLFGRSALKTASELITKDEIKTSGSEIGKVYSFLIVLTSLQAKAFLTLTTCRKLLGLSDIDYTSIMNEHLNNEKNEFRDNILPALSNKFSNPSYAKTIGSDNYAKVILESEPGYALVGFEIINDPIPVLKAYKAKLKQNYQVDNQSLSEIVYLDIDKLFCPENSEQKYYTKNLTFPDGYVITKITFEKKLNNLIYEATANFYDPSTGDIDLNKKQVESTFPQTDYITMDIGDDDGIYMPLGVISETFLTPINSFGLEVDAKSKTLTLKCKSYLREYLLESDLKNKETGLIAPPNVFISNVVKNWDIEEDSLEPWVANNKNAYVDNTGGIERSKALFTQGDGEFSQFIGDKLKPNTDYIIQYTVKGKPAIYLKNKSTGYITYEDTNGNSEEFQTIAVKFTSETDLSQTHLVFKSQNGYEAWGDNFIILEAKLFETPESPELIKFNDWERFGTTYITGNELRIDHSRGGYFRQSLNIDSYSTYDLSFSFSGLWAKVIVKNSRGVVLFEKVKNNGSSYEDISESFTTASNKDGFFIELTAERTSSTFHSFRDISIKEKIE

SEQ ID NO: 1550 - protein, 803 aa, Bacillus thuringiensis
MNKNNTKLNARALPSFIDYFNGIYGFATGIKDIMNMIFKTDTGGDLTLDEILKNQQLLNEISGKLDGVNGSLNDLIAQGNLNTELSKEILKIANEQNQVLNDVNNKLDAINTMLNIYLPKITSMLSDVMKQNYALSLQIEYLSRQLQEISDKLDVINLNVLINSTLTEITPSYQRIKYVNEKFDKLTFATESTLRAKQGIFNEDSFDNNTLENLADLAELAKSITKNDVDSFEFYLHTFHDVLIGNNLFGRSALKTASELITKDEIKTSGSEIGKVYSFLIVLTSLQAKAFLTLTTCRKLLGLSDIDYTSIMNEHLNNEKNEFRDNILPALSNKFSNPSYAKTIGSDNYAKVILESEPGYALVGFEIINDPIPVLKAYKAKLKQNYQVDNQSLSEIVYLDIDKLFCPENSEQKYYTKNLTFPDGYVITKITFEKKLNNLIYEATANFYDPSTGDIDLNKKQVESTFPQTDYITMDIGDDDGIYMPLGVISETFLTPINSFGLEVDAKSKTLTLKCKSYLREYLLESDLKNKETGLIAPPNVFISNVVKNWDIEEDSLEPWVANNKNAYVDNTGGIERSKALFTQGDGEFSQFIGDKLKPNTDYIIQYTVKGKPAIYLKNKSTGYITYEDTNGNSEEFQTIAVKFTSETDLSQTHLVFKSQNGYEAWGDNFIILEAKLFETPESPELIKFNDWERFGTTYITGNELRIDHSRGGYFRQSLNIDSYSTYDLSFSFSGLWAKVIVKNSRGVVLFEKVKNNGSSYEDISESFTTASNKDGFFIELTAERTSSTFHSFRDISIKEKIE

SEQ ID NO: 1551 - protein, 803 aa, Bacillus thuringiensis; identical to SEQ ID NO: 1549

SEQ ID NO: 1552 - protein, 803 aa, Bacillus thuringiensis; identical to SEQ ID NO: 1550

SEQ ID NO: 1553 - protein, 60 aa, Hadronyche versuta
MNTATGFIVLLVLATILGGIEAGESHMRKDAMGRVRRQYCVPVDQPCSLNTQPCCDDATC

SEQ ID NO: 1554 - protein, 76 aa, Hadronyche versuta; identical to SEQ ID NO: 569

SEQ ID NO: 1555 - protein, 75 aa, Hadronyche versuta; identical to SEQ ID NO: 572

SEQ ID NO: 1556 - protein, 38 aa, Hadronyche versuta; identical to SEQ ID NO: 573

SEQ ID NO: 1557 - protein, 75 aa, Hadronyche versuta; identical to SEQ ID NO: 574

SEQ ID NO: 1558 - protein, 38 aa, Hadronyche versuta; identical to SEQ ID NO: 575

SEQ ID NO: 1559 - protein, 76 aa, Hadronyche versuta; identical to SEQ ID NO: 576

SEQ ID NO: 1560 - protein, 76 aa, Hadronyche versuta; identical to SEQ ID NO: 578

SEQ ID NO: 1561 - protein, 39 aa, Hadronyche versuta; identical to SEQ ID NO: 579

SEQ ID NO: 1562 - protein, 76 aa, Hadronyche versuta; identical to SEQ ID NO: 580

SEQ ID NO: 1563 - protein, 39 aa, Hadronyche versuta; identical to SEQ ID NO: 581

SEQ ID NO: 1564 - protein, 76 aa, Hadronyche versuta; identical to SEQ ID NO: 582

SEQ ID NO: 1565 - protein, 39 aa, Hadronyche versuta; identical to SEQ ID NO: 581

SEQ ID NO: 1566 - protein, 76 aa, Hadronyche versuta; identical to SEQ ID NO: 584

SEQ ID NO: 1567 - protein, 39 aa, Hadronyche versuta; identical to SEQ ID NO: 581

SEQ ID NO: 1568 - protein, 76 aa, Atrax robustus; identical to SEQ ID NO: 586

SEQ ID NO: 1569 - protein, 39 aa, Atrax robustus; identical to SEQ ID NO: 581

SEQ ID NO: 1570 - protein, 22 aa, Hadronyche versuta
  MISC_FEATURE (4)..(4): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (10)..(10): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (16)..(16): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (20)..(20): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MNTXTGFIVXLVLATXLGGXEA

SEQ ID NO: 1571 - protein, 41 aa, Hadronyche versuta; identical to SEQ ID NO: 5

SEQ ID NO: 1572 - protein, 39 aa, Hadronyche versuta; identical to SEQ ID NO: 6

SEQ ID NO: 1573 - protein, 76 aa, Hadronyche versuta; identical to SEQ ID NO: 569

SEQ ID NO: 1574 - protein, 39 aa, Hadronyche versuta; identical to SEQ ID NO: 571

SEQ ID NO: 1575 - protein, 75 aa, Hadronyche versuta; identical to SEQ ID NO: 572

SEQ ID NO: 1576 - protein, 38 aa, Hadronyche versuta; identical to SEQ ID NO: 573

SEQ ID NO: 1577 - protein, 75 aa, Hadronyche versuta; identical to SEQ ID NO: 574

SEQ ID NO: 1578 - protein, 38 aa, Hadronyche versuta; identical to SEQ ID NO: 575

SEQ ID NO: 1579 - protein, 76 aa, Hadronyche versuta; identical to SEQ ID NO: 576

SEQ ID NO: 1580 - protein, 39 aa, Hadronyche versuta; identical to SEQ ID NO: 6

SEQ ID NO: 1581 - protein, 76 aa, Hadronyche versuta; identical to SEQ ID NO: 578

SEQ ID NO: 1582 - protein, 39 aa, Hadronyche versuta; identical to SEQ ID NO: 579

SEQ ID NO: 1583 - protein, 76 aa, Hadronyche versuta; identical to SEQ ID NO: 580

SEQ ID NO: 1584 - protein, 39 aa, Hadronyche versuta; identical to SEQ ID NO: 581

SEQ ID NO: 1585 - protein, 76 aa, Hadronyche versuta; identical to SEQ ID NO: 582

SEQ ID NO: 1586 - protein, 39 aa, Hadronyche versuta; identical to SEQ ID NO: 581

SEQ ID NO: 1587 - protein, 76 aa, Hadronyche versuta; identical to SEQ ID NO: 584

SEQ ID NO: 1588 - protein, 39 aa, Hadronyche versuta; identical to SEQ ID NO: 581

SEQ ID NO: 1589 - protein, 39 aa, Atrax robustus; identical to SEQ ID NO: 581

SEQ ID NO: 1590 - protein, 39 aa, Atrax robustus; identical to SEQ ID NO: 581

SEQ ID NO: 1591 - protein, 22 aa, Hadronyche versuta
  MISC_FEATURE (4)..(4): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (10)..(10): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (16)..(16): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
  MISC_FEATURE (20)..(20): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
MNTXTGFIVXLVLATXLGGXEA

SEQ ID NO: 1592 - protein, 15 aa, Hadronyche versuta
  MISC_FEATURE (1)..(1): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
XESHMRKDAMGRVRR

SEQ ID NO: 1593 - protein, 15 aa, Hadronyche versuta
  MISC_FEATURE (1)..(1): Xaa is Ala Arg Asn Asp Asx Cys Glu Gln Glx Gly His Ile Leu Lys Met Phe Pro Ser Thr Trp Tyr Val.
  MISC_FEATURE (1)..(1): Xaa is Ala, Arg, Asn, Asp, Asx, Cys, Glu, Gln, Glx, Gly, His, Ile, Leu, Lys, Met, Phe, Pro, Ser, Thr, Trp, Tyr, or Val.
XESHMRKDAMGRVRR

SEQ ID NO: 1594 - protein, 6 aa, Artificial Sequence
  cleavable linker
AFVRLF

SEQ ID NO: 1595 - protein, 5 aa, Artificial Sequence
  cleavable linker
AKLFV

SEQ ID NO: 1596 - protein, 6 aa, Artificial Sequence
  cleavable linker
ALFALK

SEQ ID NO: 1597 - protein, 5 aa, Artificial Sequence
  cleavable linker
ALFLK

SEQ ID NO: 1598 - protein, 5 aa, Artificial Sequence
  cleavable linker
ALFLR

SEQ ID NO: 1599 - protein, 4 aa, Artificial Sequence
  cleavable linker
ALFR

SEQ ID NO: 1600 - protein, 6 aa, Artificial Sequence
  cleavable linker
ALFRLR

SEQ ID NO: 1601 - protein, 6 aa, Artificial Sequence
  cleavable linker
ALKALF

SEQ ID NO: 1602 - protein, 5 aa, Artificial Sequence
  cleavable linker
ALKFF

SEQ ID NO: 1603 - protein, 6 aa, Artificial Sequence
  cleavable linker
ALKFLV

SEQ ID NO: 1604 - protein, 6 aa, Artificial Sequence
  cleavable linker
ALKFLV

SEQ ID NO: 1605 - protein, 6 aa, Artificial Sequence
  cleavable linker
ALKLFV

SEQ ID NO: 1606 - protein, 6 aa, Artificial Sequence
  cleavable linker
FFADIK

SEQ ID NO: 1607 - protein, 5 aa, Artificial Sequence
  cleavable linker
FFALK

SEQ ID NO: 1608 - protein, 4 aa, Artificial Sequence
  cleavable linker
FFLK

SEQ ID NO: 1609 - protein, 4 aa, Artificial Sequence
  cleavable linker
FFLR

SEQ ID NO: 1610 - protein, 5 aa, Artificial Sequence
  cleavable linker
FFRLR

SEQ ID NO: 1611 - protein, 6 aa, Artificial Sequence
  cleavable linker
FGYRIK

SEQ ID NO: 1612 - protein, 5 aa, Artificial Sequence
  cleavable linker
FLRLF

SEQ ID NO: 1613 - protein, 5 aa, Artificial Sequence
  cleavable linker
FYARR

SEQ ID NO: 1614 - protein, 6 aa, Artificial Sequence
  cleavable linker
GGLRKK

SEQ ID NO: 1615 - protein, 6 aa, Artificial Sequence
  cleavable linker
IFVALK

SEQ ID NO: 1616 - protein, 5 aa, Artificial Sequence
  cleavable linker
IFVLK

SEQ ID NO: 1617 - protein, 5 aa, Artificial Sequence
  cleavable linker
IFVLR

SEQ ID NO: 1618 - protein, 4 aa, Artificial Sequence
  cleavable linker
IFVR

SEQ ID NO: 1619 - protein, 6 aa, Artificial Sequence
  cleavable linker
IFVRLR

SEQ ID NO: 1620 - protein, 6 aa, Artificial Sequence
  cleavable linker
ILFNIK

SEQ ID NO: 1621 - protein, 6 aa, Artificial Sequence
  cleavable linker
LFAAPF

SEQ ID NO: 1622 - protein, 6 aa, Artificial Sequence
  cleavable linker
LFVALK

SEQ ID NO: 1623 - protein, 5 aa, Artificial Sequence
  cleavable linker
LFVLK

SEQ ID NO: 1624 - protein, 5 aa, Artificial Sequence
  cleavable linker
LFVLR

SEQ ID NO: 1625 - protein, 4 aa, Artificial Sequence
  cleavable linker
LFVR

SEQ ID NO: 1626 - protein, 6 aa, Artificial Sequence
  cleavable linker
LFVRLR

SEQ ID NO: 1627 - protein, 7 aa, Artificial Sequence
  cleavable linker
LFVRVFL

SEQ ID NO: 1628 - protein, 4 aa, Artificial Sequence
  cleavable linker
LGER

SEQ ID NO: 1629 - protein, 5 aa, Artificial Sequence
  cleavable linker
LKALF

SEQ ID NO: 1630 - protein, 4 aa, Artificial Sequence
  cleavable linker
LKFF

SEQ ID NO: 1631 - protein, 5 aa, Artificial Sequence
  cleavable linker
LKIFV

SEQ ID NO: 1632 - protein, 5 aa, Artificial Sequence
  cleavable linker
LKLFV

SEQ ID NO: 1633 - protein, 5 aa, Artificial Sequence
  cleavable linker
LRALF

SEQ ID NO: 1634 - protein, 4 aa, Artificial Sequence
  cleavable linker
LRFF

SEQ ID NO: 1635 - protein, 5 aa, Artificial Sequence
  cleavable linker
LRIFV

SEQ ID NO: 1636 - protein, 5 aa, Artificial Sequence
  cleavable linker
LRLFV

SEQ ID NO: 1637 - protein, 4 aa, Artificial Sequence
  cleavable linker
RALF

SEQ ID NO: 1638 - protein, 4 aa, Artificial Sequence
  cleavable linker
RIFV

SEQ ID NO: 1639 - protein, 4 aa, Artificial Sequence
  cleavable linker
RLFV

SEQ ID NO: 1640 - protein, 6 aa, Artificial Sequence
  cleavable linker
RLRALF

SEQ ID NO: 1641 - protein, 5 aa, Artificial Sequence
  cleavable linker
RLRFF

SEQ ID NO: 1642 - protein, 6 aa, Artificial Sequence
  cleavable linker
RLRIFV

SEQ ID NO: 1643 - protein, 6 aa, Artificial Sequence
  cleavable linker
RLRLFV

SEQ ID NO: 1644 - protein, 6 aa, Artificial Sequence
  cleavable linker
RRKAFV

SEQ ID NO: 1645 - protein, 6 aa, Artificial Sequence
  cleavable linker
RRKLIF

SEQ ID NO: 1646 - protein, 6 aa, Artificial Sequence
  cleavable linker
RRRFFA

SEQ ID NO: 1647 - protein, 6 aa, Artificial Sequence
  cleavable linker
VFGRKG

SEQ ID NO: 1648 - protein, 5 aa, Artificial Sequence
  cleavable linker
YFVRK

SEQ ID NO: 1649 - protein, 8 aa, Artificial Sequence
  cleavable linker
AFVRLFGS

SEQ ID NO: 1650 - protein, 7 aa, Artificial Sequence
  cleavable linker
AKLFVGS

SEQ ID NO: 1651 - protein, 8 aa, Artificial Sequence
  cleavable linker
ALFALKGS

SEQ ID NO: 1652 - protein, 7 aa, Artificial Sequence
  cleavable linker
ALFLKGS

SEQ ID NO: 1653 - protein, 7 aa, Artificial Sequence
  cleavable linker
ALFLRGS

SEQ ID NO: 1654 - protein, 6 aa, Artificial Sequence
  cleavable linker
ALFRGS

SEQ ID NO: 1655 - protein, 8 aa, Artificial Sequence
  cleavable linker
ALFRLRGS

SEQ ID NO: 1656 - protein, 8 aa, Artificial Sequence
  cleavable linker
ALKALFGS

SEQ ID NO: 1657 - protein, 7 aa, Artificial Sequence
  cleavable linker
ALKFFGS

SEQ ID NO: 1658 - protein, 8 aa, Artificial Sequence
  cleavable linker
ALKFLVGS

SEQ ID NO: 1659 - protein, 8 aa, Artificial Sequence
  cleavable linker
ALKIFVGS

SEQ ID NO: 1660 - protein, 8 aa, Artificial Sequence
  cleavable linker
ALKLFVGS

SEQ ID NO: 1661 - protein, 8 aa, Artificial Sequence
  cleavable linker
FFADIKGS

SEQ ID NO: 1662 - protein, 7 aa, Artificial Sequence
  cleavable linker
FFALKGS

SEQ ID NO: 1663 - protein, 6 aa, Artificial Sequence
  cleavable linker
FFLKGS

SEQ ID NO: 1664 - protein, 6 aa, Artificial Sequence
  cleavable linker
FFLRGS

SEQ ID NO: 1665 - protein, 7 aa, Artificial Sequence
  cleavable linker
FFRLRGS

SEQ ID NO: 1666 - protein, 8 aa, Artificial Sequence
  cleavable linker
FGYRIKGS

SEQ ID NO: 1667 - protein, 7 aa, Artificial Sequence
  cleavable linker
FLRLFGS

SEQ ID NO: 1668 - protein, 7 aa, Artificial Sequence
  cleavable linker
FYARRGS

SEQ ID NO: 1669 - protein, 8 aa, Artificial Sequence
  cleavable linker
GGLRKKGS

SEQ ID NO: 1670 - protein, 8 aa, Artificial Sequence
  cleavable linker
IFVALKGS

SEQ ID NO: 1671 - protein, 7 aa, Artificial Sequence
  cleavable linker
IFVLKGS

SEQ ID NO: 1672 - protein, 7 aa, Artificial Sequence
  cleavable linker
IFVLRGS

SEQ ID NO: 1673 - protein, 6 aa, Artificial Sequence
  cleavable linker
IFVRGS

SEQ ID NO: 1674 - protein, 8 aa, Artificial Sequence
  cleavable linker
IFVRLRGS

SEQ ID NO: 1675 - protein, 8 aa, Artificial Sequence
  cleavable linker
ILFNIKGS

SEQ ID NO: 1676 - protein, 8 aa, Artificial Sequence
  cleavable linker
LFAAPFGS

SEQ ID NO: 1677 - protein, 8 aa, Artificial Sequence
  cleavable linker
LFVALKGS

SEQ ID NO: 1678 - protein, 7 aa, Artificial Sequence
  cleavable linker
LFVLKGS

SEQ ID NO: 1679 - protein, 7 aa, Artificial Sequence
  cleavable linker
LFVLRGS

SEQ ID NO: 1680 - protein, 6 aa, Artificial Sequence
  cleavable linker
LFVRGS

SEQ ID NO: 1681 - protein, 8 aa, Artificial Sequence
  cleavable linker
LFVRLRGS

SEQ ID NO: 1682 - protein, 9 aa, Artificial Sequence
  cleavable linker
LFVRVFLGS

SEQ ID NO: 1683 - protein, 6 aa, Artificial Sequence
  cleavable linker
LGERGS

SEQ ID NO: 1684 - protein, 7 aa, Artificial Sequence
  cleavable linker
LKALFGS

SEQ ID NO: 1685 - protein, 6 aa, Artificial Sequence
  cleavable linker
LKFFGS

SEQ ID NO: 1686 - protein, 7 aa, Artificial Sequence
  cleavable linker
LKIFVGS

SEQ ID NO: 1687 - protein, 7 aa, Artificial Sequence
  cleavable linker
LKLFVGS

SEQ ID NO: 1688 - protein, 7 aa, Artificial Sequence
  cleavable linker
LRALFGS

SEQ ID NO: 1689 - protein, 6 aa, Artificial Sequence
  cleavable linker
LRFFGS

SEQ ID NO: 1690 - protein, 7 aa, Artificial Sequence
  cleavable linker
LRIFVGS

SEQ ID NO: 1691 - protein, 7 aa, Artificial Sequence
  cleavable linker
LRLFVGS

SEQ ID NO: 1692 - protein, 6 aa, Artificial Sequence
  cleavable linker
RALFGS

SEQ ID NO: 1693 - protein, 6 aa, Artificial Sequence
  cleavable linker
RIFVGS

SEQ ID NO: 1694 - protein, 6 aa, Artificial Sequence
  cleavable linker
RLFVGS

SEQ ID NO: 1695 - protein, 8 aa, Artificial Sequence
  cleavable linker
RLRALFGS

SEQ ID NO: 1696 - protein, 7 aa, Artificial Sequence
  cleavable linker
RLRFFGS

SEQ ID NO: 1697 - protein, 8 aa, Artificial Sequence
  cleavable linker
RLRIFVGS

SEQ ID NO: 1698 - protein, 8 aa, Artificial Sequence
  cleavable linker
RLRLFVGS

SEQ ID NO: 1699 - protein, 8 aa, Artificial Sequence
  cleavable linker
RRKAFVGS

SEQ ID NO: 1700 - protein, 8 aa, Artificial Sequence
  cleavable linker
RRKLIFGS

SEQ ID NO: 1701 - protein, 8 aa, Artificial Sequence
  cleavable linker
RRRFFAGS

SEQ ID NO: 1702 - protein, 8 aa, Artificial Sequence
  cleavable linker
VFGRKGGS

SEQ ID NO: 1703 - protein, 7 aa, Artificial Sequence
  cleavable linker
YFVRKGS

SEQ ID NO: 1704 - protein, 8 aa, Artificial Sequence
  cleavable linker
GSAFVRLF

SEQ ID NO: 1705 - protein, 7 aa, Artificial Sequence
  cleavable linker
GSAKLFV

SEQ ID NO: 1706 - protein, 8 aa, Artificial Sequence
  cleavable linker
GSALFALK

SEQ ID NO: 1707 - protein, 7 aa, Artificial Sequence
  cleavable linker
GSALFLK

SEQ ID NO: 1708 - protein, 7 aa, Artificial Sequence
  cleavable linker
GSALFLR

SEQ ID NO: 1709 - protein, 6 aa, Artificial Sequence
  cleavable linker
GSALFR

SEQ ID NO: 1710 - protein, 8 aa, Artificial Sequence
  cleavable linker
GSALFRLR

SEQ ID NO: 1711 - protein, 8 aa, Artificial Sequence
  cleavable linker
GSALKALF

SEQ ID NO: 1712 - protein, 7 aa, Artificial Sequence
  cleavable linker
GSALKFF

SEQ ID NO: 1713 - protein, 8 aa, Artificial Sequence
  cleavable linker
GSALKFLV

SEQ ID NO: 1714 - protein, 8 aa, Artificial Sequence
  cleavable linker
GSALKIFV

SEQ ID NO: 1715 - protein, 8 aa, Artificial Sequence
  cleavable linker
GSALKLFV

SEQ ID NO: 1716 - protein, 8 aa, Artificial Sequence
  cleavable linker
GSFFADIK

SEQ ID NO: 1717 - protein, 7 aa, Artificial Sequence
  cleavable linker
GSFFALK

SEQ ID NO: 1718 - protein, 6 aa, Artificial Sequence
  cleavable linker
GSFFLK

SEQ ID NO: 1719 - protein, 6 aa, Artificial Sequence
  cleavable linker
GSFFLR

SEQ ID NO: 1720 - protein, 7 aa, Artificial Sequence
  cleavable linker
GSFFRLR

SEQ ID NO: 1721 - protein, 8 aa, Artificial Sequence
  cleavable linker
GSFGYRIK

SEQ ID NO: 1722 - protein, 7 aa, Artificial Sequence
  cleavable linker
GSFLRLF

SEQ ID NO: 1723 - protein, 7 aa, Artificial Sequence
  cleavable linker
GSFYARR

SEQ ID NO: 1724 - protein, 8 aa, Artificial Sequence
  cleavable linker
GSGGLRKK

SEQ ID NO: 1725 - protein, 8 aa, Artificial Sequence
  cleavable linker
GSIFVALK

SEQ ID NO: 1726 - protein, 7 aa, Artificial Sequence
  cleavable linker
GSIFVLK

SEQ ID NO: 1727 - protein, 7 aa, Artificial Sequence
  cleavable linker
GSIFVLR

SEQ ID NO: 1728 - protein, 6 aa, Artificial Sequence
  cleavable linker
GSIFVR

SEQ ID NO: 1729 - protein, 8 aa, Artificial Sequence
  cleavable linker
GSIFVRLR

SEQ ID NO: 1730 - protein, 8 aa, Artificial Sequence
  cleavable linker
GSILFNIK

SEQ ID NO: 1731 - protein, 8 aa, Artificial Sequence
  cleavable linker
GSLFAAPF

SEQ ID NO: 1732 - protein, 8 aa, Artificial Sequence
  cleavable linker
GSLFVALK

SEQ ID NO: 1733 - protein, 7 aa, Artificial Sequence
  cleavable linker
GSLFVLK

SEQ ID NO: 1734 - protein, 7 aa, Artificial Sequence
  cleavable linker
GSLFVLR

SEQ ID NO: 1735 - protein, 6 aa, Artificial Sequence
  cleavable linker
GSLFVR

SEQ ID NO: 1736 - protein, 8 aa, Artificial Sequence
  cleavable linker
GSLFVRLR

SEQ ID NO: 1737 - protein, 9 aa, Artificial Sequence
  cleavable linker
GSLFVRVFL

SEQ ID NO: 1738 - protein, 6 aa, Artificial Sequence
  cleavable linker
GSLGER

SEQ ID NO: 1739 - protein, 7 aa, Artificial Sequence
  cleavable linker
GSLKALF

SEQ ID NO: 1740 - protein, 6 aa, Artificial Sequence
  cleavable linker
GSLKFF

SEQ ID NO: 1741 - protein, 7 aa, Artificial Sequence
  cleavable linker
GSLKIFV

SEQ ID NO: 1742 - protein, 7 aa, Artificial Sequence
  cleavable linker
GSLKLFV

SEQ ID NO: 1743 - protein, 7 aa, Artificial Sequence
  cleavable linker
GSLRALF

SEQ ID NO: 1744 - protein, 6 aa, Artificial Sequence
  cleavable linker
GSLRFF

SEQ ID NO: 1745 - protein, 7 aa, Artificial Sequence
  cleavable linker
GSLRIFV

SEQ ID NO: 1746 - protein, 7 aa, Artificial Sequence
  cleavable linker
GSLRLFV

SEQ ID NO: 1747 - protein, 6 aa, Artificial Sequence
  cleavable linker
GSRALF

SEQ ID NO: 1748 - protein, 6 aa, Artificial Sequence
  cleavable linker
GSRIFV

SEQ ID NO: 1749 - protein, 6 aa, Artificial Sequence
  cleavable linker
GSRLFV

SEQ ID NO: 1750 - protein, 8 aa, Artificial Sequence
  cleavable linker
GSRLRALF

SEQ ID NO: 1751 - protein, 7 aa, Artificial Sequence
  cleavable linker
GSRLRFF

SEQ ID NO: 1752 - protein, 8 aa, Artificial Sequence
  cleavable linker
GSRLRIFV

SEQ ID NO: 1753 - protein, 8 aa, Artificial Sequence
  cleavable linker
GSRLRLFV

SEQ ID NO: 1754 - protein, 8 aa, Artificial Sequence
  cleavable linker
GSRRKAFV

SEQ ID NO: 1755 - protein, 8 aa, Artificial Sequence
  cleavable linker
GSRRKLIF

SEQ ID NO: 1756 - protein, 8 aa, Artificial Sequence
  cleavable linker
GSRRRFFA

SEQ ID NO: 1757 - protein, 8 aa, Artificial Sequence
  cleavable linker
GSVFGRKG

SEQ ID NO: 1758 - protein, 7 aa, Artificial Sequence
  cleavable linker
GSYFVRK

SEQ ID NO: 1759 - protein, 75 aa, Zea mays
QIFVKTLTGKTITLEVESSDTIDNVKAKIQDKEGIPPDQQRLIFAGKQLEDGRTLADYNIQKESTLHLVLRLRGG

SEQ ID NO: 1760 - protein, 10 aa, Artificial Sequence
  his-tag
HHHHHHHHHH

SEQ ID NO: 1761 - protein, 56 aa, Diguetia canities
AKDGDVEGPAGCKKYDVECDSGECCQKQYLWYKWRPLDCRCLKSGFFSSKCVCRDV

SEQ ID NO: 1762 - protein, 76 aa, Apomastus schlingeri
EIPQNLGSGIPHDKIKLPNGQWCKTPGDLCSSSSECCKAKHSNSVTYASFCSRQWSGQQALFINQCRTCNVESSMC

SEQ ID NO: 1763 - protein, 61 aa, Mesobuthus tamulus sindicus
DGYILMRNGCKIPCLFGNDGCNKECKAYGGSYGYCWTYGLACACEGQPEDKKHLNYHKKTC

SEQ ID NO: 1764 - protein, 51 aa, Eratigena agrestis
EPDEICRARMTHKEFNYKSNVCNGCGDQVAACEAECFRNDVYTACHEAQKG

SEQ ID NO: 1765 - protein, 51 aa, Eratigena agrestis
EPDEICRARMTNKEFTYKSNVCNNCGDQVAACEAECFRNDVYTACHEAQKG

SEQ ID NO: 1766 - protein, 39 aa, Calisoga sp.
CISARYPCSNSKDCCSGNCGTFWTCYIRKDPCSKECLAP

SEQ ID NO: 1767 - protein, 61 aa, Androctonus australis
DGYIKRHDGCKVTCLINDNYCDTECKREGGSYGYCYSVGFACWCEGLPDDKAWKSETNTCD

SEQ ID NO: 1768 - protein, 76 aa, Apomastus schlingeri
EIPQNLGSDIPHDIIKLPNGQWCKTPGALCSSRSECCKAKHSDSVTYSSGCSRQWSDQQGLFINQCRTCNVESSMC

SEQ ID NO: 1769 - protein, 64 aa, Hottentotta judaica
GRDAYIADNLNCAYTCGSNSYCNTECTKNGAVSGYCQWLGKYGNACWCINLPDKVPIRIPGACR

SEQ ID NO: 1770 - protein, 61 aa, Leiurus quinquestriatus quinquestriatus
DGYIRKRDGCKVSCLFGNEGCDKECKAYGGSYGYCWIWGLACWCEGLPDDKTWKSETNTCG

SEQ ID NO: 1771 - protein, 61 aa, Leiurus quinquestriatus hebraeus
DGYIRGGDGCKVSCVINHVFCDNECKAAGGSYGYCWAWGLACWCEGLPADREWDYETNTCG

SEQ ID NO: 1772 - protein, 61 aa, Leiurus quinquestriatus hebraeus
DGYIRGGDGCKVSCVINHVFCDNECKAAGGSYGYCWAWGLACWCEGLPAEREWDYETNTCG

SEQ ID NO: 1773 - protein, 61 aa, Leiurus quinquestriatus hebraeus
DGYIRGGDGCKVSCVIDHVFCDNECKAAGGSYGYCWGWGLACWCEGLPADREWKYETNTCG

SEQ ID NO: 1774 - protein, 41 aa, Brachypelma smithii
CLGENVPCDKDRPNCCSRYECLEPTGYGWWYASYYCYKKRS

SEQ ID NO: 1775 - protein, 46 aa, Plectreurys tristis
AVKCIGWQETCNGNLPCCNECVMCECNIMGQNCRCNHPKATNECES

---

What is claimed is:

1. A cleavable peptide linker (L) consisting of an amino acid sequence selected from the group consisting of SEQ ID NOs: 1603, 1605, 1619, 1621, 1658, 1660, 1674, 1676, 1681 and 1683, wherein the cleavable peptide linker is cleavable by a mammal gut protease, and at least one of an insect and a nematode gut protease.

2. The cleavable peptide linker (L) of claim 1, wherein the insect gut protease is a protease derived from a Lepidoptera or a Coleoptera insect species.

3. The cleavable peptide linker (L) of claim 1, wherein the mammal gut protease is a human gastrointestinal protease.

4. The cleavable peptide linker (L) of claim 1, wherein the cleavable peptide linker (L) consists of the amino acid sequence as set forth in SEQ ID NO: 1603.

5. The cleavable peptide linker (L) of claim 1, wherein the cleavable peptide linker (L)) consists of the amino acid sequence as set forth in SEQ ID NO: 1605.

6. The cleavable peptide linker (L) of claim 1, wherein the cleavable peptide linker (L)) consists of the amino acid sequence as set forth in SEQ ID NO: 1619.

7. The cleavable peptide linker (L) of claim 1, wherein the cleavable peptide linker (L)) consists of the amino acid sequence as set forth in SEQ ID NO: 1621.

8. The cleavable peptide linker (L) of claim 1, wherein the cleavable peptide linker (L)) consists of the amino acid sequence as set forth in SEQ ID NO: 1658.

9. The cleavable peptide linker (L) of claim 1, wherein the cleavable peptide linker (L)) consists of the amino acid sequence as set forth in SEQ ID NO: 1660.

10. The cleavable peptide linker (L) of claim 1, wherein the cleavable peptide linker (L)) consists of the amino acid sequence as set forth in SEQ ID NO: 1674.

11. The cleavable peptide linker (L) of claim 1, wherein the cleavable peptide linker (L)) consists of the amino acid sequence as set forth in SEQ ID NO: 1676.

12. The cleavable peptide linker (L) of claim 1, wherein the cleavable peptide linker (L)) consists of the amino acid sequence as set forth in SEQ ID NO: 1681.

13. The cleavable peptide linker (L) of claim 1, wherein the cleavable peptide linker (L)) consists of the amino acid sequence as set forth in SEQ ID NO: 1683.

14. A polynucleotide operable to encode the cleavable peptide linker (L) of claim 1, or a complementary nucleotide sequence thereof.

15. A vector comprising a polynucleotide of claim 14.

16. A bacterial host cell, a yeast host cell, a plant host cell or an animal host cell comprising a vector of claim 15.

* * * * *